US011174297B2

(12) United States Patent
Kubo et al.

(10) Patent No.: US 11,174,297 B2
(45) Date of Patent: Nov. 16, 2021

(54) TENTOXIN SYNTHESIS GENE, A METHOD FOR PRODUCING TENTOXIN OR DIHYDROTENTOXIN USING THE SAME, AND A TRANSFORMANT COMPRISING THE SAME

(71) Applicants: NATIONAL INSTITUTE OF ADVANCED INDUSTRIAL SCIENCE AND TECHNOLOGY, Tokyo (JP); KUMIAI CHEMICAL INDUSTRY CO., LTD., Tokyo (JP)

(72) Inventors: Takashi Kubo, Sapporo (JP); Masayuki Machida, Sapporo (JP); Tomonori Fujioka, Tokyo (JP); Shigenari Yamaguchi, Tokyo (JP); Kiyoshi Kawai, Tokyo (JP)

(73) Assignee: KUMIAI CHEMICAL INDUSTRY CO., LTD., Tokyo (JP)

( * ) Notice: Subject to any disclaimer, the term of this patent is extended or adjusted under 35 U.S.C. 154(b) by 48 days.

(21) Appl. No.: 16/085,502

(22) PCT Filed: Mar. 16, 2017

(86) PCT No.: PCT/JP2017/010697
§ 371 (c)(1),
(2) Date: Sep. 14, 2018

(87) PCT Pub. No.: WO2017/159795
PCT Pub. Date: Sep. 21, 2017

(65) Prior Publication Data
US 2019/0100565 A1    Apr. 4, 2019

(30) Foreign Application Priority Data

Mar. 16, 2016  (JP) .............................. JP2016-052806

(51) Int. Cl.

| C12N 9/96 | (2006.01) |
| C07K 14/37 | (2006.01) |
| C07K 7/64 | (2006.01) |
| C12P 21/02 | (2006.01) |
| C12N 9/10 | (2006.01) |
| C12N 9/02 | (2006.01) |
| C12N 15/70 | (2006.01) |
| C12N 15/75 | (2006.01) |
| C12N 15/77 | (2006.01) |
| C12N 15/78 | (2006.01) |
| C12N 15/81 | (2006.01) |
| C12N 1/14 | (2006.01) |

(52) U.S. Cl.
CPC .............. *C07K 14/37* (2013.01); *C07K 7/64* (2013.01); *C12N 9/0077* (2013.01); *C12N 9/10* (2013.01); *C12N 9/1007* (2013.01); *C12N 15/70* (2013.01); *C12N 15/75* (2013.01); *C12N 15/77* (2013.01); *C12N 15/78* (2013.01); *C12N 15/81* (2013.01); *C12P 21/02* (2013.01); *C12N 1/14* (2013.01)

(58) Field of Classification Search
None
See application file for complete search history.

(56) References Cited

U.S. PATENT DOCUMENTS 5,827,706 A * 10/1998 Leitner .................... C12N 9/00
                                                    435/183
8,945,898 B2 * 2/2015 Van Peij .................. C12N 9/18
                                                    435/188

OTHER PUBLICATIONS

Berestetskiy, "A Review of Fungal Phytotoxins: from Basic Studies to Practical Use", Applied Biochemistry and Microbiology, 2008, vol. 44, No. 5, pp. 453-465.
Condon B.J. et al., Accession No. W6Z3C0, Diffinition:Uncharacterized protein, Uniprot [online], Apr. 16, 2014, <URL:http://www.uniprot.org/uniprot/W623C0.txt?version=1> [retrieved on Jun. 5, 2017].
De Bruyne et al., "Comparative chemical screening and genetic analysis reveal tentoxin as a new virulence factor in Cochliobolus miyabeanus, the causal agent of brown spot disease on rice", Molecular Plant Pathology, Dec. 1, 2015, vol. 17, No. 6, pp. 805-817.
Duke et al., "Invited Paper Chemicals from nature for weed management", Weed Science, Mar.-Apr. 2002, vol. 50, pp. 138-151.
Durbin et al., "A Survey of Plant Insensitivity to Tentoxin", Physiology and Biochemistry, May 1977, vol. 67, pp. 602-603.
Gao et al., "Cyclization of fungal nonribosomal peptides by a terminal condensation-like domain", Nature Chemical Biology, Oct. 2012, vol. 8, No. 10, pp. 823-830.
International Search Report, issued in PCT/JP2017/010697, dated Jun. 13, 2017.
Lax et al., "Tentoxin, a Chlorosis-Inducing Toxin from Alternaria as a Potential Herbicide", Weed Technology, 1988, vol. 2, pp. 540-544.
Ramm et al., "Biosynthesis of the Phytotoxin Tentoxin, I. Synthesis by Protoplasts of Alternaria alternata", Applied Biochemistry and Biotechnology, 1994, vol. 49, No. 1, pp. 35-43.
Ramm et al., "Studies of the biosynthesis of tentoxin by Alternaria alternata", Microbiology, 1994, vol. 140, No. 12, pp. 3257-3266.
Schwarzer et al., "Nonribosomal peptides: from genes to products", Nat. Prod. Rep., 2003, vol. 20, No. 3, pp. 275-287.

(Continued)

*Primary Examiner* — Hope A Robinson
(74) *Attorney, Agent, or Firm* — Birch, Stewart, Kolasch & Birch, LLP

(57) ABSTRACT

An object of the present invention is to identify an enzyme having activity of synthesizing dihydrotentoxin that is a tentoxin precursor and an enzyme having activity of synthesizing tentoxin using dihydrotentoxin as a substrate. The present invention concerns a tentoxin synthesis-related gene encoding a protein comprising the amino acid sequence of SEQ ID NO: 16 and having activity of nonribosomal peptide synthesis of dihydrotentoxin and a tentoxin synthesis-related gene encoding a protein comprising the amino acid sequence of SEQ ID NO: 18 and having activity of converting dihydrotentoxin to tentoxin.

15 Claims, 12 Drawing Sheets
Specification includes a Sequence Listing.

(56) References Cited

OTHER PUBLICATIONS

Steele et al., "Chloroplast coupling factor 1: A species-specific receptor for tentoxin", Proc. Natl. Acad. Sci. USA, Jul. 1976, vol. 73, No. 7, pp. 2245-2248.
Tkacz et al., "Advances in Fungal Biotechnology for Industry, Agriculture, and Medicine", 2004, Springer Science & Business Media, 54 pages.
Written Opinion of International Searching Authority, issued in PCT/JP2017/010697, dated Jun. 13, 2017.
De Bruyne, et al., "Comparative chemical screening and genetic analysis reveal tentoxin as a new virulence factor in Cochliobolus miyabeanus, the causal agent of brown spot disease on rice", Molecular Plant Pathology, vol. 17, No. 6, 2016, 48 pages total with supplemental data.
Extended European Search Report dated Jul. 30, 2019, in European Patent Application No. 17766791.2.
Li, et al., "Putative Nonribosomal Peptide Synthetase and Cytochrome P450 Genes Responsible for Tentoxin Biosynthesis in Alternaria alternata ZJ33", Toxins, vol. 8, No. 234, 2016, pp. 1-11, S1-S8 (19 pages, with supplemental data).
Seshime, et al., "Functional expression of the Aspergillus flavus PKS-NRPS hybrid CpaA involved in the biosynthesis of cyclopiazonic acid", Bioorganic & Medicinal Chemistry Letters, vol. 19, 2009, pp. 3288-3292 (5 pages).

\* cited by examiner

Fig. 4

| Transformant | Carbon source | Repetition | Tentoxin yield (μg/L) | Dihydrotentoxin peak area |
|---|---|---|---|---|
| Empty vector | Glucose | 1 | 0.00 | 0.00 |
| | | 2 | 0.00 | 0.00 |
| | | 3 | 0.00 | 0.00 |
| | Maltose | 1 | 0.00 | 0.00 |
| | | 2 | 0.00 | 0.00 |
| | | 3 | 0.00 | 0.00 |
| tenA | Glucose | 1 | 0.00 | 17540.52 |
| | | 2 | 0.00 | 18406.75 |
| | | 3 | 0.00 | 39152.66 |
| | Maltose | 1 | 0.00 | 40356.56 |
| | | 2 | 0.00 | 24969.95 |
| | | 3 | 0.00 | 49232.88 |
| P450 | Glucose | 1 | 0.00 | 0.00 |
| | | 2 | 0.00 | 0.00 |
| | | 3 | 0.00 | 0.00 |
| | Maltose | 1 | 0.00 | 0.00 |
| | | 2 | 0.00 | 0.00 |
| | | 3 | 0.00 | 0.00 |
| tenA/P450 | Glucose | 1 | 881.06 | 29639.55 |
| | | 2 | 879.59 | 43030.70 |
| | | 3 | 528.96 | 17141.40 |
| | Maltose | 1 | 4047.98 | 78629.17 |
| | | 2 | 1597.50 | 59948.12 |
| | | 3 | 1873.23 | 45390.96 |

B) Chromatogram of tentoxin preparation (UV=282nm)

A) Peak MS spectrum at retention time of 2.80 min. (UV=282nm)

Tentoxin (MW=414.5)

C) Peak MS spectrum at retention time of 2.82 min. (UV=220nm)

Dihydrotentoxin (MW=416.5)

TENTOXIN SYNTHESIS GENE, A METHOD FOR PRODUCING TENTOXIN OR DIHYDROTENTOXIN USING THE SAME, AND A TRANSFORMANT COMPRISING THE SAME

TECHNICAL FIELD

The present invention relates to a novel tentoxin synthesis-related gene involved in synthesis of tentoxin that is a cyclic peptide compound, a method for producing dihydrotentoxin using the tentoxin synthesis-related gene, a method for producing tentoxin using the tentoxin synthesis-related gene, and a transformant comprising the tentoxin synthesis-related gene.

BACKGROUND ART

Tentoxin ((2Z)-3-phenyl-N-methylcyclo(Dha-Gly-N-methyl-L-Ala-L-Leu-)) is a cyclic peptide compound produced by filamentous fungi of the genus *Alternaria* and it is known to inhibit chloroplast F1-ATPase at a low concentration (Non-Patent Document 1). When chloroplast F1-ATPase is inhibited, it prevents chlorophyll accumulation and causes chlorosis, resulting in death of plants. In this regard, tentoxin is expected to be used for herbicides (Non-Patent Documents 2 and 3). However, it is difficult to perform chemical synthesis to obtain tentoxin as an agricultural chemical at a reasonable price, which still prevents practical use of tentoxin (Non-Patent Documents 4 and 5).

Non-Patent Document 6 discloses culture production of tentoxin via synthesis of tentoxin from protoplasts of *Alternaria alternata*. Non-Patent Document 7 speculates a synthase which is involved in biosynthesis of dihydrotentoxin that is a tentoxin precursor in the biosynthesis pathway of tentoxin in *Alternaria alternata*, and also predicts the presence of an enzyme involved in dehydrogenation of dihydrotentoxin. Note that an enzyme that synthesizes dihydrotentoxin or an enzyme that dehydrogenates dihydrotentoxin has not been specifically identified by the technology disclosed in Non-Patent Document 7. Further, Non-Patent Document 8 teaches the genome structure of filamentous fungi and the overview of gene expression regulation while mentioning that no genes involved in biosynthesis of tentoxin and dihydrotentoxin have been identified.

Meanwhile, unlike peptide synthesis via mRNA or ribosome, a reaction mechanism is known in which a peptide bond is synthesized directly by a catalyst of an enzyme complex using an amino acid as a substrate. The group of enzymes, which are involved in such reaction, synthesizes peptides in a non-ribosome-dependent manner, and therefore, it is called nonribosomal peptide synthetase (NRPS). NRPS is a giant polypeptide comprising basic units called "modules" each having a plurality of functional domains bound to each other, which is an enzyme that catalyzes an amide bond formation reaction. The module structure is classified into an initiation module, an elongation module, and a termination module, each of which is composed of various domains (Non-Patent Document 9). It is known that NRPS synthesizes a basic skeleton of many of peptidic natural products.

As domains included in NRPS, an A domain (adenylation domain), a PCP domain (peptidyl carrier protein domain), and a C domain (condensation domain) are known as essential domains for basic peptide structure synthesis. In addition, there are known domains capable of modifying a peptide being synthesized as a basic structure.

Although it is known that a thioesterase (TE) domain of bacterial-derived NRPS is responsible for cyclization reaction, NRPS lacks the TE domain in many of filamentous fungi. In recent years, the C domain has been elucidated to be responsible for peptide cyclization in filamentous fungi (Non-Patent Document 10).

Incidentally, the pathogenic factor of *Cochliobolus miyabeanus* is that this strain produces tentoxin, and the NRPS gene (CmNps3 gene) is known as a tentoxin biosynthesis-related gene candidate (Non-Patent Document 11).

CITATION LIST

Non-Patent Documents

Non-Patent Document 1: Steele, J. A., et al., Chloroplast coupling factor 1: A species-specific receptor for tentoxin, Proceedings of the National Academy of Sciences, 1976, 73(7): pp. 2245-2248.

Non-Patent Document 2: Durbin, R. and T. Uchytil, A survey of plant insensitivity to tentoxin. Phytopathology, 1977. 67: pp. 602-603.

Non-Patent Document 3: Lax, A. R., H. S. Shepherd, and J. V. Edwards, Tentoxin, a chlorosis-inducing toxin from *Alternaria* as a potential herbicide, Weed Technology, 1988: pp. 540-544.

Non-Patent Document 4: Berestetskiy, A. O., A review of fungal phytotoxins: from basic studies to practical use, Applied Biochemistry and Microbiology, 2008, 44(5): pp. 453-465.

Non-Patent Document 5: Duke, S. O., et al., Chemicals from Nature for Weed Management, Weed Science, 2002: pp. 138-151.

Non-Patent Document 6: Ramm, K., B., Bruckner, and B. Liebermann, Biosynthesis of the phytotoxin tentoxin, Applied biochemistry and biotechnology, 1994, 49(1): pp. 35-43.

Non-Patent Document 7: Ramm, K., et al., Studies of the biosynthesis of tentoxin by *Alternaria alternata*, Microbiology, 1994, 140(12): pp. 3257-3266.

Non-Patent Document 8: Tkacz, J. S. and L. Lange, Advances in fungal biotechnology for industry, agriculture, and medicine, 2004: Springer Science & Business Media, Non-Patent Document 9: Schwarzer, D., R. Finking, and M. A. Marahiel, Nonribosomal peptides: from genes to products, Nat Prod Rep, 2003, 20(3): pp. 275.

Non-Patent Document 10: X Gao et al., Cyclization of fungal nonribosomal peptides by a terminal condensation-like domain, (2012) Nat Chem Biol, 2012 8(10): 823-830

Non-Patent Document 11: De Bruyne, L., et al., Comparative chemical screening and genetic analysis reveal tentoxin as a new virulence factor in *Cochliobolus miyabeanus*, the causal agent of brown spot disease on rice. Mol Plant Pathol, 2015. 17 (6): pp. 805-817

SUMMARY OF INVENTION

Technical Problem

Meanwhile, as tentoxin and its precursor, namely dihydrotentoxin, described above specifically bind to chloroplast F1-ATPase so as to inhibit chloroplast F1-ATPase activity, they are expected to be used for herbicides. However, as mentioned above, enzymes that would play important roles in biosynthesis of tentoxin or dihydrotentoxin remain unidentified and unclear. The gene candidate disclosed in Non-Patent Document 11 also has not been sufficiently analyzed. Therefore, it is unclear whether it can be used for biosynthesis of tentoxin and dihydrotentoxin.

In view of the above circumstances, an object of the present invention is to identify enzyme having activity of synthesizing dihydrotentoxin that is a tentoxin precursor and an enzyme having activity of synthesizing tentoxin using dihydrotentoxin as a substrate and to provide a system of synthesizing tentoxin and dihydrotentoxin.

Solution to Problem

As a result of intensive studies in order to achieve the above object, the present inventors succeeded in identifying a plurality of NRPS genes from the *A. alternata* genome and also identifying a gene encoding a protein having the activity of synthesizing dihydrotentoxin and a gene encoding a protein having the activity of synthesizing tentoxin from dihydrotentoxin from among the NRPS genes. This has led to the completion of the present invention.

The present invention encompasses the following.

(1) A tentoxin synthesis-related gene, which encodes a protein having activity of nonribosomal peptide synthesis of dihydrotentoxin and containing the following modules in the order below from the N-terminal side:

a first module having a first adenylation domain comprising the amino acid sequence of SEQ ID NO: 1 or an amino acid sequence having 70% or more identity with the amino acid sequence of SEQ ID NO: 1, a first peptidyl carrier protein domain comprising the amino acid sequence of SEQ ID NO: 2 or an amino acid sequence having 70% or more identity with the amino acid sequence of SEQ ID NO: 2, and a first condensation domain comprising the amino acid sequence of SEQ ID NO: 3 or an amino acid sequence having 70% or more identity with the amino acid sequence of SEQ ID NO: 3 in that order from the N-terminal side;

a second module having a second adenylation domain comprising the amino acid sequence of SEQ ID NO: 4 or an amino acid sequence having 70% or more identity with the amino acid sequence of SEQ ID NO: 4, a first N-methyltransferase domain comprising the amino acid sequence of SEQ ID NO: 5 or an amino acid sequence having 70% or more identity with the amino acid sequence of SEQ ID NO: 5, a second peptidyl carrier protein domain comprising the amino acid sequence of SEQ ID NO: 6 or an amino acid sequence having 70% or more identity with the amino acid sequence of SEQ ID NO: 6, and a second condensation domain comprising the amino acid sequence of SEQ ID NO: 7 or an amino acid sequence having 70% or more identity with the amino acid sequence of SEQ ID NO: 7 in that order from the N-terminal side;

a third module having a third adenylation domain comprising the amino acid sequence of SEQ ID NO: 8 or an amino acid sequence having 70% or more identity with the amino acid sequence of SEQ ID NO: 8, a third peptidyl carrier protein domain comprising the amino acid sequence of SEQ ID NO: 9 or an amino acid sequence having 70% or more identity with the amino acid sequence of SEQ ID NO: 9, and a third condensation domain comprising the amino acid sequence of SEQ ID NO: 10 or an amino acid sequence having 70% or more identity with the amino acid sequence of SEQ ID NO: 10 in that order from the N-terminal side; and a fourth module having a fourth adenylation domain comprising the amino acid sequence of SEQ ID NO: 11 or an amino acid sequence having 70% or more identity with the amino acid sequence of SEQ ID NO: 11, a second N-methyltransferase domain comprising the amino acid sequence of SEQ ID NO: 12 or an amino acid sequence having 70% or more identity with the amino acid sequence of SEQ ID NO: 12, a fourth peptidyl carrier protein domain comprising the amino acid sequence of SEQ ID NO: 13 or an amino acid sequence having 70% or more identity with the amino acid sequence of SEQ ID NO: 13, and a fourth condensation domain comprising the amino acid sequence of SEQ ID NO: 14 or an amino acid sequence having 70% or more identity with the amino acid sequence of SEQ ID NO: 14 in that order from the N-terminal side.

(2) The tentoxin synthesis-related gene according to (1), wherein the protein is any one of the following proteins (a) to (c):

(a) a protein comprising the amino acid sequence of SEQ ID NO: 16;

(b) a protein having activity of nonribosomal peptide synthesis of dihydrotentoxin, which comprises an amino acid sequence having 70% or more identity with the amino acid sequence of SEQ ID NO: 16; or (c) a protein having activity of nonribosomal peptide synthesis of dihydrotentoxin, which is encoded by a polynucleotide that hybridizes under stringent conditions to a complementary strand of the nucleotide sequence of SEQ ID NO: 15.

(3) The tentoxin synthesis-related gene according to (1), which is from a filamentous fungus of the genus *Alternaria*.

(4) The tentoxin synthesis-related gene according to (3), wherein the filamentous fungus is *Alternaria alternata*.

(5) A tentoxin synthesis-related gene, which encodes any one of the following proteins (a) to (c):

(a) a protein comprising the amino acid sequence of SEQ ID NO: 16;

(b) a protein having activity of nonribosomal peptide synthesis of dihydrotentoxin, which comprises an amino acid sequence having 70% or more identity with the amino acid sequence of SEQ ID NO: 16; and (c) a protein having activity of nonribosomal peptide synthesis of dihydrotentoxin, which is encoded by a polynucleotide that hybridizes under stringent conditions to a complementary strand of the nucleotide sequence of SEQ ID NO: 15.

(6) The tentoxin synthesis-related gene according to (5), wherein the protein contains the following modules in the order below from the N-terminal side:

a first module having a first adenylation domain comprising the amino acid sequence of SEQ ID NO: 1 or an amino acid sequence having 70% or more identity with the amino acid sequence of SEQ ID NO: 1, a first peptidyl carrier protein domain comprising the amino acid sequence of SEQ ID NO: 2 or an amino acid sequence having 70% or more identity with the amino acid sequence of SEQ ID NO: 2, and a first condensation domain comprising the amino acid sequence of SEQ ID NO: 3 or an amino acid sequence having 70% or more identity with the amino acid sequence of SEQ ID NO: 3 in that order from the N-terminal side;

a second module having a second adenylation domain comprising the amino acid sequence of SEQ ID NO: 4 or an amino acid sequence having 70% or more identity with the amino acid sequence of SEQ ID NO: 4, a first N-methyltransferase domain comprising the amino acid sequence of SEQ ID NO: 5 or an amino acid sequence having 70% or more identity with the amino acid sequence of SEQ ID NO: 5, a second peptidyl carrier protein domain comprising the amino acid sequence of SEQ ID NO: 6 or an amino acid sequence having 70% or more identity with the amino acid sequence of SEQ ID NO: 6, and a second condensation domain comprising the amino acid sequence of SEQ ID NO: 7 or an amino acid sequence having 70% or more identity with the amino acid sequence of SEQ ID NO: 7 in that order from the N-terminal side;

a third module having a third adenylation domain comprising the amino acid sequence of SEQ ID NO: 8 or an amino acid sequence having 70% or more identity with the amino acid sequence of SEQ ID NO: 8, a third peptidyl carrier protein domain comprising the amino acid sequence of SEQ ID NO: 9 or an amino acid sequence having 70% or more identity with the amino acid sequence of SEQ ID NO: 9, and a third condensation domain comprising the amino acid sequence of SEQ ID NO: 10 or an amino acid sequence having 70% or more identity with the amino acid sequence of SEQ ID NO: 10 in that order from the N-terminal side; and a fourth module having a fourth adenylation domain comprising the amino acid sequence of SEQ ID NO: 11 or an amino acid sequence having 70% or more identity with the amino acid sequence of SEQ ID NO: 11, a second N-methyltransferase domain comprising the amino acid sequence of SEQ ID NO: 12 or an amino acid sequence having 70% or more identity with the amino acid sequence of SEQ ID NO: 12, a fourth peptidyl carrier protein domain comprising the amino acid sequence of SEQ ID NO: 13 or an amino acid sequence having 70% or more identity with the amino acid sequence of SEQ ID NO: 13, and a fourth condensation domain comprising the amino acid sequence of SEQ ID NO: 14 or an amino acid sequence having 70% or more identity with the amino acid sequence of SEQ ID NO: 14 in that order from the N-terminal side.

(7) The tentoxin synthesis-related gene according to (5), which is from the filamentous fungus of the genus *Alternaria*.

(8) The tentoxin synthesis-related gene according to (7), wherein the filamentous fungus is *Alternaria alternata*.

(9) A tentoxin synthesis-related gene, which encodes any one of the following proteins (a) to (c):

(a) a protein comprising the amino acid sequence of SEQ ID NO: 18;

(b) a protein having activity of converting dihydrotentoxin to tentoxin, which comprises an amino acid sequence having 70% or more identity with the amino acid sequence of SEQ ID NO: 18; and (c) a protein having activity of converting dihydrotentoxin to tentoxin, which is encoded by a polynucleotide that hybridizes under stringent conditions to a complementary strand of the nucleotide sequence of SEQ ID NO: 17.

(10) The tentoxin synthesis-related gene according to (9), which is from a filamentous fungus of the genus *Alternaria*.

(11) The tentoxin synthesis-related gene according to (10), wherein the filamentous fungus is *Alternaria alternata*.

(12) A method for producing dihydrotentoxin, comprising the steps of:

culturing a transformant into which the tentoxin synthesis-related gene according to any one of (1) to (8) has been introduced; and collecting dihydrotentoxin from the culture supernatant.

(13) The method for producing dihydrotentoxin according to (12), wherein the transformant is a filamentous fungus into which the tentoxin synthesis-related gene has been introduced in an expressible manner.

(14) A method for producing tentoxin, comprising the steps of:

culturing a transformant into which the tentoxin synthesis-related gene according to any one of (1) to (8) and the tentoxin synthesis-related gene according to any one of (9) to (11) have been introduced; and collecting tentoxin from the culture supernatant.

(15) The method for producing tentoxin according to (14), wherein the transformant is a filamentous fungus into which the two types of tentoxin synthesis-related genes have been introduced in an expressible manner.

(16) A transformant, into which the tentoxin synthesis-related gene according to any one of (1) to (8) has been introduced.

(17) A transformant, into which the tentoxin synthesis-related gene according to any one of (9) to (11) has been introduced.

(18) A transformant, into which the tentoxin synthesis-related gene according to any one of (1) to (8) and the tentoxin synthesis-related gene according to any one of (9) to (11) have been introduced.

(19) The transformant according to any one of (16) to (18), wherein the gene has been introduced into koji mold (*Aspergillus oryzae*).

Advantageous Effects of Invention

According to the present invention, it is possible to provide a tentoxin synthesis-related gene encoding a nonribosomal peptide synthetase capable of synthesizing dihydrotentoxin and a tentoxin synthesis-related gene encoding an enzyme capable of converting dihydrotentoxin to tentoxin. It is also possible to construct a system of synthesizing dihydrotentoxin and tentoxin using the tentoxin synthesis-related gene(s) of the present invention so as to produce dihydrotentoxin and/or tentoxin with good efficiency.

BRIEF DESCRIPTION OF DRAWINGS

FIG. 4 shows a table listing the results of calculation of yields of tentoxin and dihydrotentoxin via UPLC analysis of metabolites in cells and culture supernatants of the transformants prepared in the Examples.

DESCRIPTION OF EMBODIMENTS

[Tentoxin Synthesis Gene]

Figure 1:
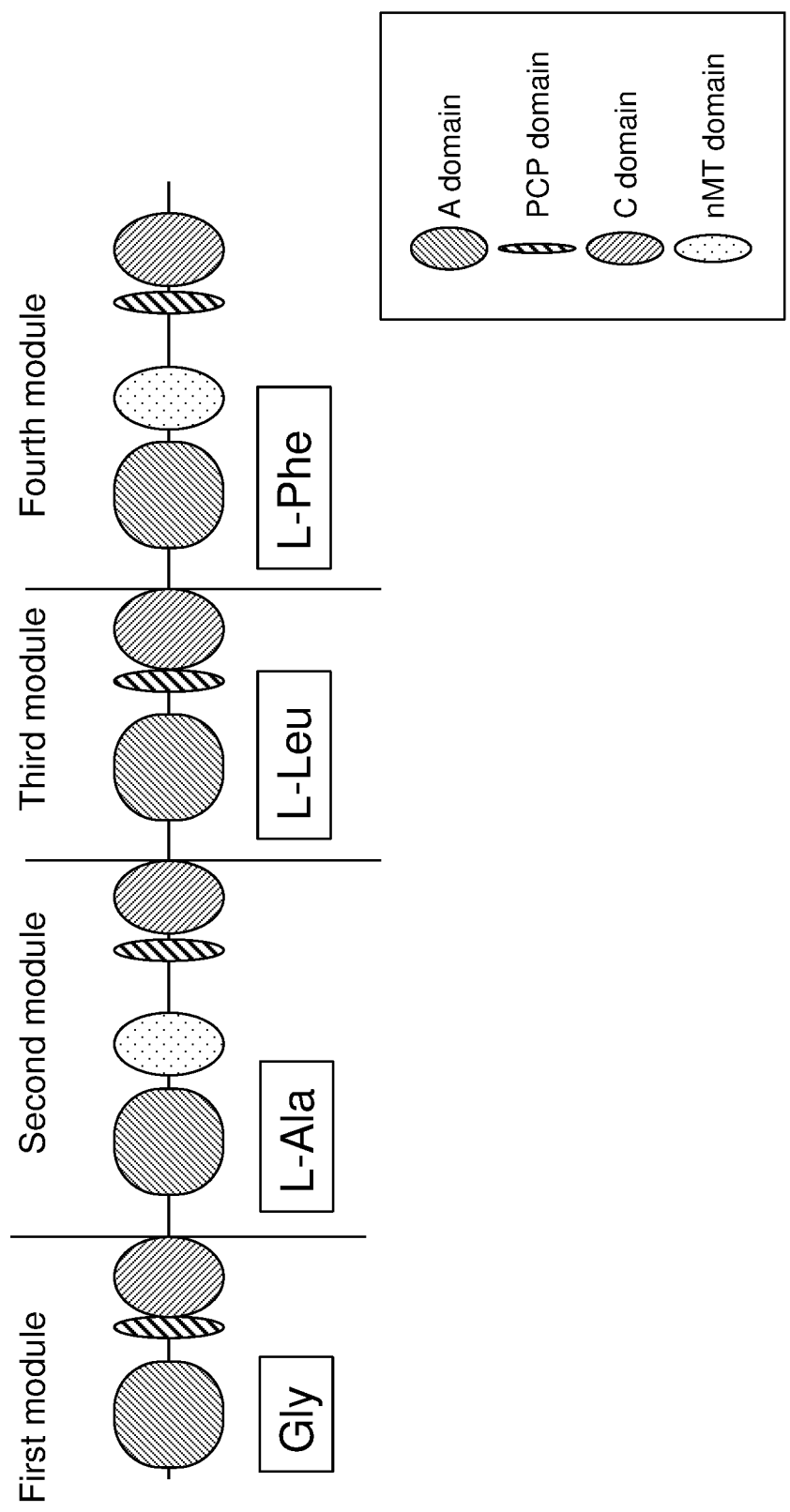
FIG. 1 schematically shows the configuration of the NRPS gene of the present invention.

The tentoxin synthesis-related gene(s) of the present invention includes a gene encoding a nonribosomal peptide synthetase capable of synthesizing dihydrotentoxin that is a tentoxin precursor and a gene encoding an enzyme capable of converting dihydrotentoxin to tentoxin. The nonribosomal peptide synthetase capable of synthesizing dihydrotentoxin that is a tentoxin precursor is hereinafter simply referred to as "NRPS" and a gene encoding NRPS is hereinafter referred to as the "NRPS gene." In addition, an enzyme capable of converting dihydrotentoxin to tentoxin is hereinafter referred to as "cytochrome P450," "P450," "oxidoreductase," or the like, and a gene encoding cytochrome P450 is hereinafter referred to as the "P450 gene." Note that the systematic name of dihydrotentoxin containing L-alanine, L-leucine, pheylalanine and glycine as constituent units is cyclo(L-Leu-N-methyl-D-Phe-Gly-N-methyl-L-Ala-). The systematic name of tentoxin is (2Z)-3-phenyl-N-methylcyclo(Dha-Gly-N-methyl-L-Ala-L-Leu-).

[NRPS Gene]

NRPS that synthesizes dihydrotentoxin has activity of forming a peptide bond between a carboxyl group of L-alanine and an amino group of L-leucine; a peptide bond between a carboxyl group of L-leucine and an amino group of phenylalanine; a peptide bond between a carboxyl group of phenylalanine and an amino group of glycine; and a peptide bond between a carboxyl group of the glycine and an amino group of the above-mentioned L-alanine. In addition, NRPS that synthesizes dihydrotentoxin has activity of methylating a peptide bond between L-leucine and phenylalanine and a peptide bond between glycine and L-alanine.

NRPS having dihydrotentoxin synthesis activity has four modules that correspond to L-alanine, L-leucine, L-phenylalanine, and glycine. Each module has an A domain (adenylation domain) that incorporates an amino acid of interest and causes the amino acid to bind to AMP (adenosine monophosphate) so as to synthesize aminoacyl AMP. In addition, each module has a PCP domain (peptidyl carrier protein domain) that contains phosphopantetheine and binds to aminoacyl AMP via thioester formed between serine of the phosphopantetheine and the aminoacyl AMP. Further, each module has a C domain (condensation domain) that is adjacent to the PCP domain and forms a peptide bond between aminoacyl AMPs that bind to adjacent PCP domains. Furthermore, some of modules have an nMT domain (N-methyltransferase domain) that methylates the formed peptide bond.

NRPS having the above activity is composed of a first module, a second module, a third module, and a fourth module as illustrated in FIG. 1. Note that the position of each module of NRPS corresponds to the position of an amino acid that constitutes a peptide to be biosynthesized. In addition, the position of each module having an nMT domain corresponds to the position of an N-methylated peptide bond. In NRPS having the above activity, an nMT domain is present in a second module and a fourth module. As is apparent from the chemical structure of tentoxin, a peptide bond of L-alanine and a peptide bond of L-phenylalanine are N-methylated. Therefore, a combination of an amino acid corresponding to the second module and an amino acid corresponding to the fourth module is limited to a combination of L-alanine and L-phenylalanine or a combination of L-phenylalanine and L-alanine. In addition, Ramm et al. suggest based on the in vitro analysis of the peptide synthesis mechanism that tentoxin is synthesized when amino acids are bound to each other in series starting from glycine or when a dipeptide of L-glycine and L-alanine is bound to a dipeptide of L-phenylalanine and L-leucine (Non-Patent Document 7). Based on the comprehensive understanding of the above findings, it is considered that the first module corresponds to glycine of dihydrotentoxin, the second module corresponds to L-alanine of dihydrotentoxin, the third module corresponds to L-leucine of dihydrotentoxin, and the fourth module corresponds to L-phenylalanine of dihydrotentoxin in NRPS having the above activity.

The first module has a first A domain comprising the amino acid sequence of SEQ ID NO: 1, a first PCP domain comprising the amino acid sequence of SEQ ID NO: 2, and a first C domain comprising the amino acid sequence of SEQ ID NO: 3 in that order from the N-terminal side. Note that the first A domain, the first PCP domain, and the first C domain in the first module are not limited to the amino acid sequences of SEQ ID NOS: 1, 2, and 3, respectively. As long as they function as an A domain, a PCP domain, and a C domain, they may comprise amino acid sequences having 70% or more identity, preferably 80% or more identity, more preferably 90% or more identity, further preferably 95% or more identity, and most preferably 97% or more identity with the amino acid sequences of SEQ ID NOS: 1, 2, and 3, respectively.

The second module has a second A domain comprising the amino acid sequence of SEQ ID NO: 4, a first nMT domain comprising the amino acid sequence of SEQ ID NO: 5, a second PCP domain comprising the amino acid sequence of SEQ ID NO: 6, and a second C domain comprising the amino acid sequence of SEQ ID NO: 7 in that order from the N-terminal side. Note that the second A domain, the first nMT domain, the second PCP domain, and the second C domain in the second module are not limited to the amino acid sequences of SEQ ID NOS: 4, 5, 6, and 7, respectively. As long as they function as an A domain, an nMT domain, a PCP domain, and a C domain, they may comprise amino acid sequences having 70% or more identity, preferably 80% or more identity, more preferably 90% or more identity, further preferably 95% or more identity, and most preferably 97% or more identity with the amino acid sequences of SEQ ID NOS: 4, 5, 6, and 7, respectively.

The third module has a third A domain comprising the amino acid sequence of SEQ ID NO: 8, a third PCP domain comprising the amino acid sequence of SEQ ID NO: 9, and a third C domain comprising the amino acid sequence of SEQ ID NO: 10 in that order from the N-terminal side. Note that the third A domain, the third PCP domain, and the third C domain in the third module are not limited to the amino acid sequences of SEQ ID NOS: 8, 9, and 10. As long as they function as an A domain, a PCP domain, and a C domain, they may comprise amino acid sequences having 70% or more identity, preferably 80% or more identity, more preferably 90% or more identity, further preferably 95% or more identity, and most preferably 97% or more identity with the amino acid sequences of SEQ ID NOS: 8, 9 and 10, respectively.

The fourth module has a fourth A domain comprising the amino acid sequence of SEQ ID NO: 11, a second nMT domain comprising the amino acid sequence of SEQ ID NO: 12, a fourth PCP domain comprising the amino acid sequence of SEQ ID NO: 13, and a fourth C domain comprising the amino acid sequence of SEQ ID NO: 14 in that order from the N-terminal side. Note that the fourth A domain, the second nMT domain, the fourth PCP domain, and the fourth C domain in the fourth module are not limited to the amino acid sequences of SEQ ID NOS: 11, 12, 13, and 14, respectively. As long as they function as an A domain, an nMT domain, a PCP domain, and a C domain, they may comprise amino acid sequences having 70% or more identity, preferably 80% or more identity, more preferably 90% or more identity, further preferably 95% or more identity, and most preferably 97% or more identity with the amino acid sequences of SEQ ID NOS: 11, 12, 13, and 14, respectively.

Here, it is possible to evaluate in the manner described below whether the first A domain can function as an A domain corresponding to glycine when it has an amino acid sequence other than the amino acid sequence of SEQ ID NO: 1. First, a mutant NRPS gene is designed such that it encodes a first mutant A domain designed as having an amino acid sequence other than the amino acid sequence of SEQ ID NO: 1. The mutant NRPS gene is expressed in an appropriate host in order to confirm whether dihydrotentoxin of interest is synthesized in metabolites in the host and a culture supernatant thereof. If it is confirmed that dihydrotentoxin is synthesized in metabolites, it is possible to evaluate that the designed first mutant A domain can function as an A domain corresponding to glycine. Note that when the second to fourth A domains have amino acid sequences, which differ from the amino acid sequences of SEQ ID NOS: 4, 8, and 11, respectively, it is also possible to evaluate whether they can function as an A domain in the same manner.

In addition, it is possible to evaluate in the manner described below whether the first PCP domain can function as a PCP domain when it has an amino acid sequence other than the amino acid sequence of SEQ ID NO: 2. First, a mutant NRPS gene is designed such that it encodes a first mutant PCP domain designed as having an amino acid sequence other than the amino acid sequence of SEQ ID NO: 2. The mutant NRPS gene is expressed in an appropriate host in order to confirm whether dihydrotentoxin of interest is synthesized in metabolites in the host and a culture supernatant thereof. If it is confirmed that dihydrotentoxin is synthesized in metabolites, it is possible to evaluate that the designed first mutant PCP domain can function as a PCP domain. Note that when the second to fourth PCP domains have amino acid sequences, which differ from the amino acid sequences of SEQ ID NOS: 6, 9, and 13, respectively, it is also possible to evaluate whether they can function as a PCP domain in the same manner.

Further, it is possible to evaluate in the manner described below whether the first C domain can function as a C domain when it has an amino acid sequence other than the amino acid sequence of SEQ ID NO: 3. First, a mutant NRPS gene is designed such that it encodes a first mutant C designed as having an amino acid sequence other than the amino acid sequence of SEQ ID NO: 3. The mutant NRPS gene is expressed in an appropriate host in order to confirm whether dihydrotentoxin of interest is synthesized in metabolites in the host and a culture supernatant thereof. If it is confirmed that dihydrotentoxin is synthesized in metabolites, it is possible to evaluate that the designed first mutant C domain can function as a C domain. Note that when the second to fourth C domains have amino acid sequences, which differ from the amino acid sequences of SEQ ID NO: 7, 10, and 14, respectively, it is also possible to evaluate whether they can function as a C domain in the same manner.

Furthermore, it is possible to evaluate in the manner described below whether the first nMT domain can function as an nMT domain when it has an amino acid sequence other than the amino acid sequence of SEQ ID NO: 5. First, a mutant NRPS gene is designed such that it encodes a first mutant nMT domain designed as having an amino acid sequence other than the amino acid sequence of SEQ ID NO: 5. The mutant NRPS gene is expressed in an appropriate host in order to confirm whether dihydrotentoxin of interest is synthesized in metabolites in the host and a culture supernatant thereof. If it is confirmed that dihydrotentoxin is synthesized in metabolites, it is possible to evaluate that the designed first mutant nMT domain can function as an nMT domain. Note that when the second nMT domain has an amino acid sequence, which differs from the amino acid sequence of SEQ ID NO: 12, it is also possible to evaluate whether it can function as an nMT domain in the same manner.

As stated above, the NRPS gene can be defined with the first to fourth modules. In one example, the amino acid sequence of *Alternaria alternata*-derived NRPS having dihydrotentoxin synthesis activity is set forth in SEQ ID NO: 16, and the nucleotide sequence of the coding region corresponding to the amino acid sequence of SEQ ID NO: 16 is set forth in SEQ ID NO: 15.

Accordingly, the NRPS gene of the present invention may be a gene encoding a protein having the above first to fourth modules defined with the amino acid sequences of SEQ ID NOS: 1 to 14, comprising an amino acid sequence having 70% or more identity, preferably 80% or more identity, more preferably 90% or more identity, further preferably 95% or more identity, and most preferably 97% or more identity with the amino acid sequence of SEQ ID NO: 16, and having dihydrotentoxin synthesis activity. Identity between amino acid sequences can be calculated by the BLASTN or BLASTX program incorporating the BLAST algorithm (at the default setting). The value of identity is expressed as a percentage of amino acid residues that are perfectly matched in a pair of amino acid sequences upon pairwise alignment analysis, which is calculated with respect to all amino acid residues for comparison.

In addition, the NRPS gene of the present invention may be a gene encoding a protein having the first to fourth modules defined with the amino acid sequences of SEQ ID NOS: 1 to 14, comprising an amino acid sequence containing a substitution, deletion, inersion, or addition of one or more amino acids with respect to the amino acid sequence of SEQ ID NO: 16, and having dihydrotentoxin synthesis activity. Here, the expression "more amino acids" means, for example, 2 to 510 amino acids, preferably 2 to 400 amino acids, more preferably 2 to 300 amino acids, further preferably 2 to 100 amino acids, yet further preferably 2 to 50 amino acids, yet further preferably 2 to 20 amino acids, and yet further preferably 2 to 10 amino acids.

Further, the NRPS gene of the present invention may be a gene encoding a protein that has the aforementioned first to fourth modules defined with the amino acid sequences of SEQ ID NOS: 1 to 14, hybridizes under stringent conditions with all of or a part of a complementary strand of DNA comprising the nucleotide sequence of SEQ ID NO: 15, and has dihydrotentoxin synthesis activity. The term "stringent conditions" used herein refers to conditions in which a so-called specific hybrid is formed and a non-specific hybrid is not formed. Such conditions can be appropriately determined with reference to, for example, Molecular Cloning: A Laboratory Manual (Third Edition). Specifically, stringency can be set based on a temperature and a salt concentration in a solution upon Southern hybridization and a temperature and a salt concentration in a solution in the washing step of Southern hybridization. Stringent conditions include, for example, a sodium concentration of 25 to 500 mM and preferably 25 to 300 mM, and a temperature of 42° C. to 68° C. and preferably 42° C. to 65° C. More specifically, stringent conditions include 5×SSC (83 mM NaCl, 83 mM sodium citrate) and a temperature of 42° C.

Meanwhile, the NRPS gene of the present invention is not limited to a gene encoding a protein having the first to fourth modules defined with the amino acid sequences of SEQ ID NOS: 1 to 14. As stated above, the amino acid sequence of *Alternaria alternata*-derived NRPS having dihydrotentoxin synthesis activity is set forth in SEQ ID NO: 16, and the nucleotide sequence of the coding region corresponding to the amino acid sequence is set forth in SEQ ID NO: 15. It is also possible to specify the NRPS gene of the present invention based on SEQ ID NOS: 15 and 16.

In other words, the NRPS gene of the present invention may be a gene encoding a protein comprising the amino acid sequence of SEQ ID NO: 16.

Further, the NRPS gene of the present invention may be a gene encoding a protein comprising an amino acid sequence having 70% or more identity, preferably 80% or more identity, more preferably 90% or more identity, further preferably 95% or more identity, and most preferably 97% or more identity with the amino acid sequence of SEQ ID NO: 16 and having dihydrotentoxin synthesis activity. Identity between amino acid sequences can be calculated by the BLASTN or BLASTX program incorporating the BLAST algorithm (at the default setting) in the manner described above. The value of identity is expressed as a percentage of amino acid residues that are perfectly matched in a pair of amino acid sequences upon pairwise alignment analysis, which is calculated with respect to all amino acid residues for comparison in the manner described above.

Furthermore, it is possible to identify, as the NRPS gene of the present invention, a gene satisfying conditions in which it has a high coverage, a low E-value, and high identity with respect to the nucleotide sequence of SEQ ID NO: 15 based on a known database storing nucleotide sequence information. Here, conditions for the gene to be identified may include a coverage of 90% or more, preferably 95% or more, and more preferably 99% or more. In addition, conditions for the gene to be identified may include an E-value of 1.0e-5 or less, preferably 1.0e-15 or less, and more preferably 0.0. Further, conditions for the gene to be identified may include 70% or more, preferably 75% or more, more preferably 78% or more identity. A gene identified as satisfying the above conditions is highly likely to be a gene homologous to the NRPS gene comprising the nucleotide sequence of SEQ ID NO: 15. Therefore, such gene can be identified as a gene encoding a protein having dihydrotentoxin synthesis activity as with the NRPS gene comprising the nucleotide sequence of SEQ ID NO: 15.

Specifically, it is possible to identify the three homologous genes listed in the table below by conducting Blast search on the NCBI database using the nucleotide sequence of SEQ ID NO: 15 as a query sequence. These homologous genes are highly likely to encode proteins capable of synthesizing dihydrotentoxin.

It is possible to confirm whether any one of the genes listed in Table 1 encodes a protein having dihydrotentoxin synthesis activity by obtaining a microorganism having the gene and verifying dihydrotentoxin and/or tentoxin synthesis ability of the microorganism. It is possible to verify dihydrotentoxin and/or tentoxin synthesis ability of the obtained microorganism by culturing the microorganism and confirming whether dihydrotentoxin or tentoxin is contained in cultured cells or a culture supernatant thereof.

In other words, the NRPS gene of the present invention is not limited to a gene encoding a protein having the first to fourth modules specified with the amino acid sequences of SEQ ID NOS: 1 to 14. It may be a gene encoding a protein comprising the amino acid sequence of SEQ ID NO: 20, 22, or 24.

In addition, the NRPS gene of the present invention may be a gene encoding a protein comprising an amino acid sequence having 70% or more identity, preferably 80% or more identity, more preferably 90% or more identity, further preferably 95% or more identity, and most preferably 97% or more identity with any one of the amino acid sequences of SEQ ID NOS: 20, 22, and 24 and having dihydrotentoxin synthesis activity. Identity between amino acid sequences can be calculated by the BLASTN or BLASTX program incorporating the BLAST algorithm (at the default setting) in the manner described above. The value of identity is expressed as a percentage of amino acid residues that are perfectly matched in a pair of amino acid sequences upon pairwise alignment analysis, which is calculated with respect to all amino acid residues for comparison in the manner described above.

Meanwhile, the NRPS gene of the present invention may be a gene encoding a protein comprising an amino acid sequence containing a substitution, deletion, inersion, or addition of one or more amino acids with respect to any one of the amino acid sequences of SEQ ID NOS: 16, 20, 22, and 24 and having dihydrotentoxin synthesis activity. Here, the expression "more amino acids" means, for example, 2 to 510 amino acids, preferably 2 to 400 amino acids, more preferably 2 to 300 amino acids, further preferably 2 to 100 amino acids, yet further preferably 2 to 50 amino acids, yet further preferably 2 to 20 amino acids, and yet further preferably 2 to 10 amino acids as stated above.

Further, the NRPS gene of the present invention may be a gene encoding a protein that hybridizes under stringent conditions with all of or a part of a complementary strand of DNA comprising any one of the nucleotide sequences of SEQ ID NOS: 15, 19, 21 and 23 and has dihydrotentoxin synthesis activity. The term "stringent conditions" used herein refers to conditions in which a so-called specific

TABLE 1

| | Maximum score | Total score | Coverage | E-value | Identity | Accession No. | SEQ ID NO. |
|---|---|---|---|---|---|---|---|
| *Cochliobolus sativus* ND90Pr hypothetical protein mRNA | 10233 | 10233 | 99% | 0.0 | 79% | XM_007702544.1 | 19, 20 |
| *Bipolaris oryzae* ATCC 44560 hypothetical protein partial mRNA | 9756 | 9756 | 99% | 0.0 | 78% | XM_007691097.1 | 21, 22 |
| *Cochliobolus heterostrophus* nonribosomal peptide synthetase 3 (NPS3) gene, complete cds | 9485 | 9485 | 99% | 0.0 | 78% | AY884188.1 | 23, 24 | hybrid is formed and a non-specific hybrid is not formed. Such conditions can be appropriately determined with reference to, for example, Molecular Cloning: A Laboratory Manual (Third Edition). Specifically, stringency can be set based on a temperature and a salt concentration in a solution upon Southern hybridization and a temperature and a salt concentration in a solution in the washing step of Southern hybridization. Stringent conditions include, for example, a sodium concentration of 25 to 500 mM and preferably 25 to 300 mM, and a temperature of 42° C. to 68° C. and preferably 42° C. to 65° C. More specifically, stringent conditions include 5×SSC (83 mM NaCl, 83 mM sodium citrate) and a temperature of 42° C.

As stated above, it is possible to confirm whether a gene comprising a nucleotide sequence other than the nucleotide sequence of SEQ ID NO: 15 or a gene encoding an amino acid sequence other than the amino acid sequence SEQ ID NO: 16 encodes a protein having dihydrotentoxin synthesis activity by introducing the gene into a host in which the gene can be expressed and verifying whether a culture product and/or a culture supernatant thereof contains dihydrotentoxin.

As an aside, once the nucleotide sequence of the NRPS gene of the present invention is determined, it is possible to produce the gene by chemical synthesis, PCR using the genome DNA as a template, or hybridization using a DNA fragment having the nucleotide sequence as a probe. Further, it is also possible to synthesize the gene comprising a nucleotide sequence other than the nucleotide sequence of SEQ ID NO: 15 or the gene encoding an amino acid sequence other than the amino acid sequence of SEQ ID NO: 16 by performing, for example, site-directed mutagenesis of a polynucleotide comprising the nucleotide sequence of SEQ ID NO: 15. In addition, in order to introduce a mutation into a polynucleotide comprising the nucleotide sequence of SEQ ID NO: 15, it is possible to employ a known method such as the Kunkel method or the gapped duplex method or a method established based on such method. For instance, it is possible to perform mutagenesis using a mutagenesis kit (e.g., Mutant-K (Takara Bio Inc.) or Mutant-G (Takara Bio Inc.)) or an LA PCR in vitro Mutagenesis series kit (Takara Bio Inc.) for site-directed mutagenesis.

In particular, the NRPS gene of the present invention can be isolated from a microorganism that is known to produce tentoxin and/or dihydrotentoxin. In one example, the NRPS gene (i.e., the NRPS gene encoding the amino acid sequence of SEQ ID NO: 16) can be isolated from *Alternaria alternata*.

In addition, it is highly possible to isolate the NRPS gene of the present invention from a filamentous fungus of the genus *Alternaria* other than *Alternaria alternata* using the nucleotide sequence of SEQ ID NO: 15. In other words, it is highly possible to isolate the NRPS gene of the present invention from the genome of a filamentous fungus of the genus *Alternaria* other than *Alternaria alternata* or cDNA from a transcript thereof via a hybridization reaction using, as a probe, a polynucleotide comprising a continuous nucleotide sequence that constitutes the nucleotide sequence of SEQ ID NO: 15. Note that a filamentous fungus of the genus *Alternaria* other than *Alternaria alternata* may or may not produce tentoxin. This is because even a filamentous fungus of the genus *Alternaria* that does not produce tentoxin is likely to have the NRPS gene of the present invention.

Examples of a filamentous fungus of the genus *Alternaria* other than *Alternaria alternata* include *Alternaria alternantherae, Alternaria arborescens, Alternaria arbusti, Alternaria blumeae, Alternaria brassicae, Alternaria brassicicola, Alternaria burnsii, Alternaria carotiincultae, Alternaria carthami, Alternaria celosiae, Alternaria cinerariae, Alternaria citri, Alternaria conjuncta, Alternaria cucumerina, Alternaria dauci, Alternaria dianthi, Alternaria dianthicola, Alternaria eichhorniae, Alternaria euphorbiicola, Alternaria gaisen, Alternaria helianthi, Alternaria helianthicola, Alternaria hungarica, Alternaria infectoria, Alternaria japonica, Alternaria kikutiana, Alternaria limicola, Alternaria linicola, Alternaria longipes, Alternaria mali, Alternaria molesta, Alternaria panax, Alternaria perpunctulata, Alternaria petroselini, Alternaria porri, Alternaria radicina, Alternaria raphani, Alternaria saponariae, Alternaria selini, Alternaria senecionis, Alternaria solani, Alternaria smyrnii, Alternaria tenuis, Alternaria tenuissima, Alternaria tomatophila, Alternaria triticina*, and *Alternaria zinniae*.

[P450 Gene]

The P450 gene of the present invention is a gene encoding a protein having activity of converting dihydrotentoxin to tentoxin. In one example of the P450 gene of the present invention, the amino acid sequence of *Alternaria alternata*-derived P450 having activity of converting dihydrotentoxin to tentoxin is set forth in SEQ ID NO: 18, and the nucleotide sequence of the coding region corresponding to the amino acid sequence is set forth in SEQ ID NO: 17. The P450 gene of the present invention can be defined based on SEQ ID NOS: 17 and 18.

In other words, the P450 gene of the present invention may be a gene encoding a protein comprising the amino acid sequence of SEQ ID NO: 18.

In addition, the P450 gene of the present invention may be a gene encoding a protein comprising an amino acid sequence having 70% or more identity, preferably 80% or more identity, more preferably 90% or more identity, further preferably 95% or more identity, and most preferably 97% or more identity with the amino acid sequence of SEQ ID NO: 18 and protein having activity of converting dihydrotentoxin to tentoxin. Identity between amino acid sequences can be calculated by the BLASTN or BLASTX program incorporating the BLAST algorithm (at the default setting) in the manner described above. The value of identity is expressed as a percentage of amino acid residues that are perfectly matched in a pair of amino acid sequences upon pairwise alignment analysis, which is calculated with respect to all amino acid residues for comparison in the manner described above.

Further, the P450 gene of the present invention may be a gene encoding a protein comprising an amino acid sequence containing a substitution, deletion, inersion, or addition of one or more amino acids with respect to the amino acid sequence of SEQ ID NO: 18 and having activity of converting dihydrotentoxin to tentoxin. Here, the expression "more amino acids" means, for example, 2 to 50 amino acids, preferably 2 to 40 amino acids, more preferably 2 to 30 amino acids, further preferably 2 to 20 amino acids, yet further preferably 2 to 10 amino acids, and yet further preferably 2 to 5 amino acids as stated above.

Furthermore, the P450 gene of the present invention may be a gene encoding a protein that hybridizes under stringent conditions with all of or a part of a complementary strand of DNA comprising the nucleotide sequence of SEQ ID NO: 17 and has activity of converting dihydrotentoxin to tentoxin. The term "stringent conditions" used herein refers to conditions in which a so-called specific hybrid is formed and a non-specific hybrid is not formed. Such conditions can be appropriately determined with reference to, for example, Molecular Cloning: A Laboratory Manual (Third Edition). Specifically, stringency can be set based on a temperature and a salt concentration in a solution upon Southern hybridization and a temperature and a salt concentration in a solution in the washing step of Southern hybridization. Stringent conditions include, for example, a sodium concentration of 25 to 500 mM and preferably 25 to 300 mM, and a temperature of 42° C. to 68° C. and preferably 42° C. to 65° C. More specifically, stringent conditions include 5×SSC (83 mM NaCl, 83 mM sodium citrate) and a temperature of 42° C.

As stated above, it is possible to confirm whether a gene comprising a nucleotide sequence other than the nucleotide sequence of SEQ ID NO: 17 or a gene encoding an amino acid sequence other than the amino acid sequence SEQ ID NO: 18 encodes a protein having activity of converting dihydrotentoxin to tentoxin by introducing the gene into a host (e.g., a host into which the NRPS gene has been introduced) having dihydrotentoxin synthesis activity in an expressible manner and verifying whether a culture product and/or a culture supernatant thereof contains tentoxin.

As an aside, once the nucleotide sequence of the P450 gene of the present invention is determined, it is possible to produce the gene by chemical synthesis, PCR using the genome DNA as a template, or hybridization using a DNA fragment having the nucleotide sequence as a probe. Further, it is also possible to synthesize the gene comprising a nucleotide sequence other than the nucleotide sequence of SEQ ID NO: 17 or the gene encoding an amino acid sequence other than the amino acid sequence of SEQ ID NO: 18 by performing, for example, site-directed mutagenesis of a polynucleotide comprising the nucleotide sequence of SEQ ID NO: 17. In addition, in order to introduce a mutation into a polynucleotide comprising the nucleotide sequence of SEQ ID NO: 17, it is possible to employ a known method such as the Kunkel method or the gapped duplex method or a method established based on such method. For instance, it is possible to perform mutagenesis using a mutagenesis kit (e.g., Mutant-K (Takara Bio Inc.) or Mutant-G (Takara Bio Inc.)) or an LA PCR in vitro Mutagenesis series kit (Takara Bio Inc.) for site-directed mutagenesis.

In particular, the P450 gene of the present invention can be isolated from a microorganism that is known to produce tentoxin and/or dihydrotentoxin. In one example, the P450 gene (i.e., the P450 gene encoding the amino acid sequence of SEQ ID NO: 18) can be isolated from *Alternaria alternata*.

In addition, it is possible to isolate the P450 gene of the present invention from a filamentous fungus of the genus *Alternaria* other than *Alternaria alternata* using the nucleotide sequence of SEQ ID NO: 17 with a high probability. In other words, it is possible to isolate the P450 gene of the present invention from the genome of a filamentous fungus of the genus *Alternaria* other than *Alternaria alternata* or cDNA from a transcript thereof via a hybridization reaction using, as a probe, a polynucleotide comprising a continuous nucleotide sequence that constitutes the nucleotide sequence of SEQ ID NO: 17. Note that a filamentous fungus of the genus *Alternaria* other than *Alternaria alternata* may or may not produce tentoxin. This is because even a filamentous fungus of the genus *Alternaria* that does not produce tentoxin is likely to have the P450 gene of the present invention.

Examples of a filamentous fungus of the genus *Alternaria* other than *Alternaria alternata* include *Alternaria alternantherae, Alternaria arborescens, Alternaria arbusti, Alternaria blumeae, Alternaria brassicae, Alternaria brassicicola, Alternaria burnsii, Alternaria carotiincultae, Alternaria carthami, Alternaria celosiae, Alternaria cinerariae, Alternaria citri, Alternaria conjuncta, Alternaria cucumerina, Alternaria dauci, Alternaria dianthi, Alternaria dianthicola, Alternaria eichhorniae, Alternaria euphorbiicola, Alternaria gaisen, Alternaria helianthi, Alternaria helianthicola, Alternaria hungarica, Alternaria infectoria, Alternaria japonica, Alternaria kikutiana, Alternaria limicola, Alternaria linicola, Alternaria longipes, Alternaria mali, Alternaria molesta, Alternaria panax, Alternaria perpunctulata, Alternaria petroselini, Alternaria porri, Alternaria radicina, Alternaria raphani, Alternaria saponariae, Alternaria selini, Alternaria senecionis, Alternaria solani, Alternaria smyrnii, Alternaria tenuis, Alternaria tenuissima, Alternaria tomatophila, Alternaria triticina*, and *Alternaria zinniae*.

[Transformants]

Among the above examples of the tentoxin synthesis-related gene of the present invention, the NRPS gene is introduced in an expressible manner into a host, thereby making it possible to produce a transformant capable of synthesizing dihydrotentoxin. In addition, a transformant capable of synthesizing tentoxin can be produced by introducing both the NRPS gene and the P450 gene in an expressible manner into a host. In addition, a transformant capable of synthesizing tentoxin can be produced by introducing the P450 gene into a host capable of synthesizing dihydrotentoxin.

A host that can be used herein is not particularly limited to and it may be any organism and especially any microorganism. Examples of a microorganism that can be used as a host include, but are not particularly limited to: bacteria of the genus *Escherichia* such as *Escherichia coli*, corynebacteria such as *Corynebacterium glutamicum*, bacteria of the genus *Bacillus* such as *Bacillus subtilis*, bacteria of the genus *Pseudomonas* such as *Pseudomonas putida*, and bacteria of the genus *Rhizobium* such as *Rhizobium meliloti*; yeasts such as *Saccharomyces cerevisiae, Schizosaccharomyces pombe*, and *Pichia pastoris*; and fungi such as filamentous fungi.

When a bacterium such as *Escherichia coli* is used as a host, it is preferable for an expression vector to be able to autonomously replicate in the bacterium and to be composed of a promoter, a ribosomal binding sequence, the aforementioned gene, and a transcription termination sequence. In addition, the expression vector may contain a gene that regulates promoter activity.

Any promoter can be used as long as it can be expressed in the host such as *Escherichia coli*. Examples of a promoter that can be used include *Escherichia coli*-derived promoters such as a trp promoter, a lac promoter, a PL promoter, and a PR promoter and phage-derived promoters such as a T7 promoter. Further, an artificially modified promoter such as a tac promoter may be used.

A method for introducing an expression vector having the above gene is not particularly limited as long as DNA is introduced into a bacterium. Examples of such method include a method using calcium ions [Cohen, S. N., et al.: Proc. Natl. Acad. Sci., USA, 69:2110-2114 (1972)] and the electroporation method.

In addition, a yeast that can be used as a host is not particularly limited. However, examples thereof include yeasts of the genus *Candida* such as *Candida Shehatae*, yeasts of the genus *Pichia* such as *Pichia stipitis*, yeasts of the genus *Pachysolen* such as *Pachysolen tannophilus*, yeasts of the genus *Saccharomyces* such as *Saccharomyces cerevisiae*, and yeasts of the genus *Schizosaccharomyces* such as *Schizosaccharomyces pombe*. *Saccharomyces cerevisiae* is particularly preferable.

Moreover, in order to enhance the expression of the NRPS gene or the P450 gene described above, a suitable promoter having high transcriptional activity is used. Examples of such promoter that can be used include, but are not particularly limited to, a glyceraldehyde-3-phosphate dehydrogenase gene (TDH3) promoter, a 3-phosphoglyceretokinase gene (PGK1) promoter, and a high osmotic response 7 gene (HOR7) promoter. In particular, a pyruvate decarboxylase gene (PDC1) promoter is preferable because it is highly capable of causing a downstream gene of interest to be highly expressed. In addition, it is possible to cause the downstream gene to be highly expressed using a promoter such as a gal1 promoter, a gal10 promoter, a heat shock protein promoter, an MFα1 promoter, a PHO5 promoter, a GAP promoter, an ADH promoter, or an AOX1 promoter.

Examples of a filamentous fungus that can be used as a host include, but are not particularly limited to: filamentous fungi of the genus *Aspergillus* such as *Aspergillus nidulans*, *Aspergillus niger*, *Aspergillus oryzae*, *Aspergillus sojae*, and *Aspergillus glaucus*; filamentous fungi of the genus *Trichoderma* such as *Trichoderma reesei* and *Trichoderma viride*; filamentous fungi of the genus *Rhizomucor* such as *Rhizomucor pusillus* and *Rhizomucor miehei*; filamentous fungi of the genus *Penicillium* such as *Penicillium notatum* and *Penicillium chrysogenum*; filamentous fungi of the genus *Rhizopus* such as *Rhizopus oryzae*; *Acremonium cellulolyticus*; *Humicola grisea*; and *Thermoaseus aurantiacus*. Of the filamentous fungi of the genus *Aspergillus*, *Aspergillus oryzae* is particularly preferable as a host.

When the NRPS gene or the P450 gene described above is expressed in a filamentous fungus, it is possible to use a promoter such as α-amylase gene (amyB) promoter, an α-glucosidase gene (agdA) promoter, a glucoamylase gene promoter (glaA), a tryptophan biosynthesis gene (trpC) promoter, an alcohol dehydrogenase gene (alcA) promoter, a translation elongation factor gene (tef1) promoter, a triose phosphate isomerase gene (tpiA) promoter, a glyceraldehyde-3-phosphate dehydrogenase (gpdA) gene promoter, an enolase (enoA) promoter, a pyruvate carboxylase (pdcA) promoter, or a cellobiohydrolase gene (cbh1) promoter.

Any conventional technique known as a technique for transformation of yeasts and filamentous fungi can be used for introduction of the above gene. Specific examples thereof include the transformation method, the transfection method, the conjugation method, the protoplast method, the spheroplast method, the electroporation method, the lipofection method, and the lithium acetate method.

[Production of Dihydrotentoxin or Tentoxin]

Tentoxin or dihydrotentoxin can be produced using the transformant described above. Specifically, dihydrotentoxin can be produced using a transformant into which the NRPS gene selected from among the above tentoxin synthesis-related genes of the present invention has been introduced in an expressible manner. In addition, tentoxin can be produced using a transformant into which both the NRPS gene and the P450 gene have been introduced in an expressible manner. Alternatively, tentoxin can be produced using a transformant obtained by introducing the P450 gene in an expressible manner into a host capable of synthesizing dihydrotentoxin.

Cells are separated from a culture supernatant of tentoxin or dihydrotentoxin synthesized in a transformant using a centrifuge, Miracloth, or the like, and then, an organic solvent such as ethyl acetate is added for extraction of tentoxin or dihydrotentoxin. Tentoxin or dihydrotentoxin is released from the inside to the outside of cells by a physical disruption method (via a homogenizer, glass bead disruption, freeze-thawing, etc.) or a chemical disruption method (via solvent treatment, acid-base treatment, osmotic treatment, enzymatic treatment, etc.) and then extracted with the addition of an organic solvent such as ethyl acetate. Extracted tentoxin or dihydrotentoxin can be purified by a conventional purification method (e.g., chromatography or salt precipitation). The above methods can be performed in combination if needed.

Tentoxin produced in the above manner can be used for, e.g., herbicides. Dihydrotentoxin produced in the above manner can be used as a tentoxin precursor, which is a material for tentoxin synthesis. In addition, dihydrotentoxin can be used as a material for a tentoxin analog having herbicidal activity comparable to or exceeding that of tentoxin.

More specifically, when tentoxin is used for herbicides, it may be used as is. However, in general, tentoxin is mixed with a suitable solid carrier, liquid carrier, surfactant, or other formulation adjuvants such that the mixture can be used in an arbitrary dosage form such as an emulsion, an EW product, a liquid, a suspension, a wettable powder, wettable granules, a powder, a DL powder, fine granules, a fine-granular product F, granules, tablets, an oil agent, an aerosol, a flowable formulation, a dry flowable formulation, or microcapsules.

Examples of a solid carrier include an animal or plant powder such as starch, activated carbon, soy flour, wheat flour, wood powder, fish powder, or milk powder and an inorganic powder such as talc, kaolin, bentonite, calcium carbonate, zeolite, diatomite, white carbon, clay, alumina, ammonium sulfate, or urea.

Examples of a liquid carrier include: water; alcohols such as isopropyl alcohol and ethylene glycol; ketones such as cyclohexanone and methyl ethyl ketone; ethers such as dioxane and tetrahydrofuran; aliphatic hydrocarbons such as kerosene and light gas oil; aromatic hydrocarbons such as xylene, trimethyl benzene, tetramethyl benzene, methyl naphthalene, and solvent naphtha; halogenated hydrocarbons such as chlorobenzene; acid amides such as dimethylacetamide; esters such as fatty acid glycerine ester; nitriles such as acetonitrile; and sulfide compounds such as dimethyl sulfoxide.

Examples of a surfactant include alkylbenzene sulfonic acid metal salt, dinaphthyl methane disulfonic acid metal salt, alcohol sulfate ester salt, alkylarylsulfonic acid salt, lignin sulphonic acid salt, polyoxyethylene glycol ether, polyoxyethylene alkyl aryl ether, and polyoxyethylensorbitan monoalkylate.

Examples of other formulation adjuvants that can be used include adhesives or thickening agents such as carboxymethyl cellulose, gum Arabic, sodium alginate, guar gum, tragantgam, and polyvinyl alcohol; anti-foaming agents such as metallic soaps; material enhancers such as fatty acid, alkylphosphate, silicone, and paraffin; and colorants.

In general, it is possible to apply a variety of herbicide formulations and dilutions thereof by a widely used application method such as spraying (e.g., nebulization, misting, atomizing, powder spraying, granule spraying, submerged application, or box application), soil application (e.g., mixing or irrigation), surface application (e.g., coating, dust coating, or covering), soaking, toxic baiting, or smoking. It is also possible to employ a so-called ultra low volume (high concentration) spraying method. According to this method, the active ingredient content can be set to 100%.

Further, it is obviously understood that a herbicide containing tentoxin as an active ingredient is sufficiently effective even if it consists of tentoxin alone as an active ingredient. However, if necessary, such herbicide may be mixed or used in combination with other fertilizers, agricultural chemicals such as insecticides, miticides, nematicides, disinfectants, antivirals, insect attractants, and other herbicides, plant growth regulators, and the like. In such case, more excellent effects may be obtained.

Examples of known herbicide compounds and plant growth regulators, which may be mixed or used in combination, are listed as follows. Examples thereof include, but are not limited to, 2,2,2-trichloroacetatic acid (TCA) (e.g., a salt of sodium, calcium, or ammonia), 2,3,6-trichlorobenzoic acid (2,3,6-TBA), 2,4,5-trichlorophenoxyacetic acid (2,4,5-T), 2,4-D choline salt, 2,4-dichlorophenoxyacetic acid (2,4-D) (e.g., a salt of amine, diethylamine, triethanolamine, isopropylamine, sodium, or lithium), 2-methyl-4-chlorophenoxy acetic acid (MCPA), 2-methyl-4-chlorophenoxybutyric acid (MCPB) (e.g., a sodium salt or ethyl ester), 4,6-dinitro-O-cresol (DNOC) (e.g., a salt of amine or sodium), 4-(2,4-dichlorophenoxy) butyric acid (2,4-DB), ACN, AE-F-150944 (code number), DSMA, HW-02, IR-6396, MCPA-thioethyl, S-ethyl dipropylthiocarbamate (EPTC), S-metolachlor, SW-065, SYP-298 (code number), SYP-300 (code number), ioxynil, aclonifen, acrolein, azafenidin, acifluorfen (e.g., a salt formed with sodium), asulam, azimsulfuron, acetochlor, atrazine, anilofos, amicarbazone, amitrole, amidosulfuron, aminocyclopyrachlor, aminopyralid, amiprofos-methyl, ametryn, alachlor, alloxydim, isouron, isoxachlortole, isoxaflutole, isoxaben, isoproturon, ipfencarbazone, imazaquin, imazapic (e.g., a salt formed with amine), imazapyr (e.g., a salt of isopropylamine), imazamethabenz-methyl, imazamox, imazethapyr, imazosulfuron, indaziflam, indanofan, eglinazine-ethyl, esprocarb, ethametsulfuron-methyl, ethalfluralin, ethidimuron, ethoxysulfuron, ethoxyfen-ethyl, ethofumesate, etobenzanid, endothal-disodium, oxadiazon, oxadiargyl, oxaziclomefone, oxasulfuron, oxyfluorfen, oryzalin, orthosulfamuron, orbencarb, oleic acid, cafenstrole, carfentrazone-ethyl, karbutilate, carbetamide, quizalofop-P-ethyl, quizalofop-P-tefuryl, quizalofop-ethyl, quinoclamine, quinclorac, quinmerac, cumyluron, clacyfos, clethodim, clodinafop-propargyl, clopyralid, clomazone, chlomethoxyfen, clomeprop, cloransulam-methyl, chloramben, chloridazon, chlorimuron-ethyl, chlorsulfuron, chlorthal-dimethyl, chlorthiamid, chlorphthalim, chlorflurenol-methyl, chlorbromuron, chlorpropham, chlormequat chloride, chloroxuron, chlorotoluron, glyphosate (e.g., a salt of sodium, amine, propylamine, isopropylamine, dimethylamine, or trimesium), glufosinate-P-sodium, glufosinate (e.g., a salt of amine or sodium), ketospirodox, (ketospirodox-potassium, saflufenacil, sarmentine, cyanazine, cyanamide, cycloate, cycloxydim, cyclosulfamuron, cyclopyrimorate, siduron, cinidon-ethyl, cinosulfuron, cyhalofop-butyl, simazine, simetryn, cinmethylin, diuron, diethatyl-ethyl, dicamba (e.g., a salt of amine, diethylamine, isopropylamine, diglycolamine, sodium, or lithium), diclosulam, dichlobenil, diclofop-P-methyl, diclofop-methyl, dichlorprop-P, dichlorprop, diquat, dithiopyr, dinitramine, dinoseb, dinoterb, diphenamid, difenzoquat, diflufenican, diflufenzopyr, diflumetorim, dimethachlor, dimethametryn, dimethenamid-P, dimethenamid, dimepiperate, dimefuron, swep, sulcotrione, sulfentrazone, sulfosate, sulfosulfuron, sulfometuron-methyl, sethoxydim, terbacil, thaxtomin A, daimuron, dazomet, dalapon, thiazopyr, tiafenacil, thiencarbazone (e.g., a sodium salt or methyl ester), tiocarbazil, thiobencarb, thidiazimin, thifensulfuron-methyl, thenylchlor, tefuryltrione, tebutam, tebuthiuron, tepraloxydim, tembotrione, terbuthylazine, terbutryn, terbumeton, desmedipham, desmetryne, topramezone, tralkoxydim, triaziflam, triasulfuron, triafamone, tri-allate), trietazine, triclopyr-butotyl, triclopyr, tritosulfuron, trifludimoxazin, triflusulfuron-methyl, trifluralin, trifloxysulfuron-sodium, tribenuron-methyl, tolpyralate, naptalam (e.g., a salt formed with sodium), naproanilide, napropamide-M, napropamide, nicosulfuron, neburon, norflurazon, halauxifen-benzyl, halauxifen-methyl, haloxyfop-etotyl, haloxyfop-P, haloxyfop, halosafen, halosulfuron-methyl, vernolate, paraquat dichloride, bicyclopyrone, bispyribac-sodium, bifenox, bilanafos, picloram, picolinafen, pinoxaden, piperophos, pyraclonil, pyrasulfotole, pyrazoxyfen, pyrazosulfuron-ethyl, pyrazolynate, pyraflufen-ethyl, pyridafol, pyrithiobac-sodium, pyridate, pyriftalid, pyributicarb, pyribenzoxim, pyrimisulfan, pyriminobac-methyl, pyroxasulfone, pyroxsulam, phenisopham, fenuron, fenoxasulfone, fenoxaprop-P-ethyl, fenoxaprop-P, fenquinotrione, fenclorim, fenthiaprop-ethyl, fentrazamide, phenmedipham, foramsulfuron, flazasulfuron, flamprop-M (e.g., methyl, ethyl, or isopropyl ester), flamprop (e.g., methyl, ethyl, or isopropyl ester), fluazifop-P-butyl, fluazifop-butyl, fluazolate, fluometuron, fluoroglycofen-ethyl, flucarbazone-sodium, fluchloralin, flucetosulfuron, fluthiacet-methyl, flupyrsulfuron-methyl-sodium, flufenacet, flufenpyr-ethyl, flupropanate, flupoxame, flumioxazin, flumiclorac-pentyl, flumetsulam, fluridone, flurtamone, flurprimidol, fluroxypyr, flurochloridone, florasulam, butachlor, butafenacil, butamifos, butylate, butenachlor, butralin, butroxydim, bromacil, brompyrazon, bromoxynil (e.g., an ester body of butyric acid, octanoic acid, or heptanoic acid), bromofenoxim, bromobutide, primisulfuron-methyl, pretilachlor, procarbazone-sodium, prodiamine, prosulfuron, prosulfocarb, propaquizafop, propachlor, propazine, propanil, propyzamide, propisochlor, propyrisulfuron, propham, profluazol, profoxydim, ropoxycarbazone-sodium, prometryn, prometon, hexazinone, heptamaloxyloglucan, benazolin, beflubutamid, bencarbazone, bensulide, bensulfuron-methyl, benzfendizone, benzobicyclon, benzofenap, bentazone, benfluralin, benfuresate, pethoxamid, penoxsulam, pebulate, pelargonic acid, pendimethalin, pentanochlor, pentoxazone, fosamine, fomesafen, foramsulfuron, maleic hydrazide, mecoprop-P-potassium, mecoprop (e.g., a salt of sodium, potassium, isopropylamine, triethanolamine, or dimethylamine), mesosulfuron-methyl, mesotrione, metazachlor, metazosulfuron, methabenzthiazuron, metamitron, metamifop, methiozolin, methyldymuron, metoxuron, metosulam, metsulfuron-methyl, metobromuron, metobenzuron, metolachlor, metribuzin, mefenacet, monosulfuron-methyl, monosulfuron, monolinuron, molinate, iodosulfuron, iodosulfulon-methyl-sodium, iofensulfuron-sodium, iofensulfuron, lactofen, linuron, rimsulfuron, lenacil, 1-naphthylacetamide, 1-methylcyclopropene, 2,6-diisopropylnaphthalene, 4-oxo-4-(2-phenylethyl) aminobutyric acid (chemical name, CAS registration number: 1083-55-2), 4-chlorophenoxyacetic acid (4-CPA), PESA (4-oxo-[(2-phenylethyl) amino]butanoic acid), n-decyl alcohol (n-decanol), aviglycine, ancymidol, inabenfide, indole acetic acid, indole butyric acid, uniconazole-P, uniconazole, ecolyst, ethychlozate, ethephon, epocholeone, carvone, cloxyfonac-potassium, cloxyfonac, cloprop, chlormequat, cytokinins, cyclanilide, sintofen, dikegulac, gibberellin acid, dimethipin, daminozide, thidiazuron, triacontanol, trinexapac-ethyl, paclobutrazol, flumetralin, flurprimidol, flurenol, prohydrojasmon, prohexadione-calcium, heptamaloxyloglucan, benzylaminopurine, forchlorfenuron, maleic hydrazide, mepiquat chloride, mefluidide, and calcium peroxide.

EXAMPLES

The present invention is described in more detail with reference to the Examples below. However, the scope of the present invention is not limited to the Examples.

Example 1

<Genome Analysis of *Alternaria alternata*>

Conidia of *A. alternata* were inoculated into 200 ml of a CM liquid medium (in a 500-ml Erlenmeyer flask) and cultured on a shaker (130 rpm) at 26° C. for 48 hours. The cultured cells were collected using Miracloth and pressed using a spatula for dehydration. The cells were placed in a mortar that had been cooled to −20° C. in advance and liquid nitrogen was poured thereto such that the cells were frozen. The cells were quickly ground into a powder by a pestle, followed by genome DNA extraction using a DNeasy Plant Maxi Kit.

Genome analysis was conducted using two types of next-generation sequencers (5500×1 SOLiD (Life Technologies) and MiSeq (Illumina)). A library was prepared from the genome DNA of *A. alternata* obtained above using a 5500 SOLiD Mate-Paired Library Kit (for 5500×1 SOLiD) and a Nextera DNA Sample Prep Kit (for MiSeq). Genome analysis was conducted using the next-generation sequencers.

<Searching for the NRPS Gene of *A. alternata*>

A database of amino acid sequences of putative proteins was created based on the results of genome analysis using the next-generation sequencers. Then, NRPS capable of synthesizing dihydrotentoxin was searched for using the database.

In the Examples, all candidate genes encoding NRPS in the genome of *A. alternata* were searched for. A gene capable of biosynthesizing the basic peptide structure of dihydrotentoxin was presumed based on structural characteristics of the putative proteins. Specifically, at first, all NRPS genes of *A. alternata* were searched by homology search with NRPS of closely related filamentous fungus *Cochliobolus heterostrophus*. Twelve NRPS genes, i.e., NPS1-12, were identified from *C. heterostrophus* (Lee, B. N., et al., Functional analysis of all nonribosomal peptide synthetases in *Cochliobolus heterostrophus* reveals a factor, NPS6, involved in virulence and resistance to oxidative stress. Eukaryot Cell, 2005. 4(3): pp. 545-55). As a result of examination of the domain structures of these twelve NRPS genes, NPS7 was found to be PKS (polyketide synthase) hybrid-type NRPS, and NPS10 and NPS12 were found to be NRPS-like proteins lacking the C domain. In view of this, BLASTP search was performed on the above database using, as queries, amino acid sequences of NPS1-6, NPS8, NPS9, and NPS11 other than the above three genes. In consideration of the report that filamentous fungi have about 10 NRPS(s) (12 NRPS(s) in *C. heterostrophus* and 14 NRPS(s) in *Asperillus fumigatus* (Stack, D., C. Neville, and S. Doyle, Nonribosomal peptide synthesis in *Aspergillus fumigatus* and other fungi. Microbiology, 2007. 153(Pt 5): pp. 1297-306)), top 20 genes which had been hit for each query gene were selected. As a result, the genes were narrowed down to 28 putative NRPS genes for *A. alternata*.

Blastx search of the GenBank database was conducted using, as a query, the genome DNA sequence from 3000 bp upstream of the putative start codon to 3000 bp downstream of the putative stop codon of each of the 28 putative NRPS genes selected above. As a result of this search, a region having homology with the known protein sequence was clarified, and thus, start and stop codons of each gene were predicted. Similarly, a site where an intron was present was indicated based on homology with the known protein sequence. Thus, the intron site was estimated in accordance with the GU-AG rule so as to predict more precise CDS. As a result, it was revealed that 2 out of 28 putative NRPS genes, which had been predicted to be different genes, were actually a single gene.

Subsequently, the domain structures of proteins encoded by the genes for which CDS had been predicted were examined. For this analysis, InterProScan (www.ebi.ac.uk/Tools/pfa/iprscan/) and antiSMASH (www.secondarymetabolites.org/) programs were used. As a result of analysis with antiSMASH, genes having the A domain, the PCP domain, and the C domain essential for the NRPS functions were 8 out of 27 putative NRPS genes. The results suggested that *A. alternata* has 8 NRPS genes.

<Prediction of NRPS Involved in Dihydrotentoxin Biosynthesis>

As stated above, as *A. alternata* was thought to have 8 putative NRPS genes, a gene capable of biosynthesizing the basic skeleton of dihydrotentoxin was searched for among the genes. Note that tentoxin has been revealed to be biosynthesized using dihydrotentoxin as a precursor (Liebermann, B. and W. Ihn, Dihydrotentoxin: a precursor of tentoxin or its degradation product? Journal of basic microbiology, 1988. 28(1-2): pp. 63-70).

In general, a peptide biosynthesized by NRPS is characterized in that the number of constitutive amino acids corresponds to the number of modules contained in NRPS. Therefore, it was considered that NRPS capable of biosynthesizing dihydrotentoxin comprising 4 amino acids has 4 modules, that is to say, 4 A domains. In view of this, the number of A domains was examined for 8 putative NRPS genes of *A. alternata*. As a result, 2 putative NRPS genes were each found to have 4 A domains. Further, 2 of 4 peptide bonds in a dihydrotentoxin molecule were N-methylated. It was therefore hypothesized that NRPS capable of biosynthesizing dihydrotentoxin has 2 nMT domains capable of N-methylating amino groups of constitutive amino acids. Thus, genes satisfying this hypothesis were searched for. The genes were narrowed down to one putative NRPS gene. This gene was designated as tenA.

<Prediction of the Enzyme Capable of Converting Dihydrotentoxin to Tentoxin>

Tentoxin has a structure in which a side chain portion of a phenylalanine residue which constitutes dihydrotentoxin is oxidized. It was therefore considered that the selected NRPS gene (tenA) and oxidase are involved in biosynthesis of tentoxin. In general, genes involved in biosynthesis of secondary metabolites are disposed on the genome to form a group (a cluster). Accordingly, the above oxidase gene was considered likely to be present in the vicinity of the tenA gene. Thus, the functions of genes present in the vicinity of tenA on the *A. alternata* genome were examined. As a result, a gene annotated as ent-kaurene oxidase, which was adjacent to and located upstream of the tenA gene, was found. This gene was found to encode cytochrome P450 (homologous to CYP512A), which is an oxidase. This suggested that the gene is likely to catalyze a reaction of converting dihydrotentoxin to tentoxin. This gene was designated as the P450 gene.

<Tentoxin Production by the tenA and P450 Genes>

As stated above, biosynthesis of tentoxin was conducted using the tenA gene estimated as a gene encoding NRPS capable of synthesizing dihydrotentoxin and the P450 gene estimated as a gene encoding an enzyme capable of converting dihydrotentoxin to tentoxin.

Figure 2:
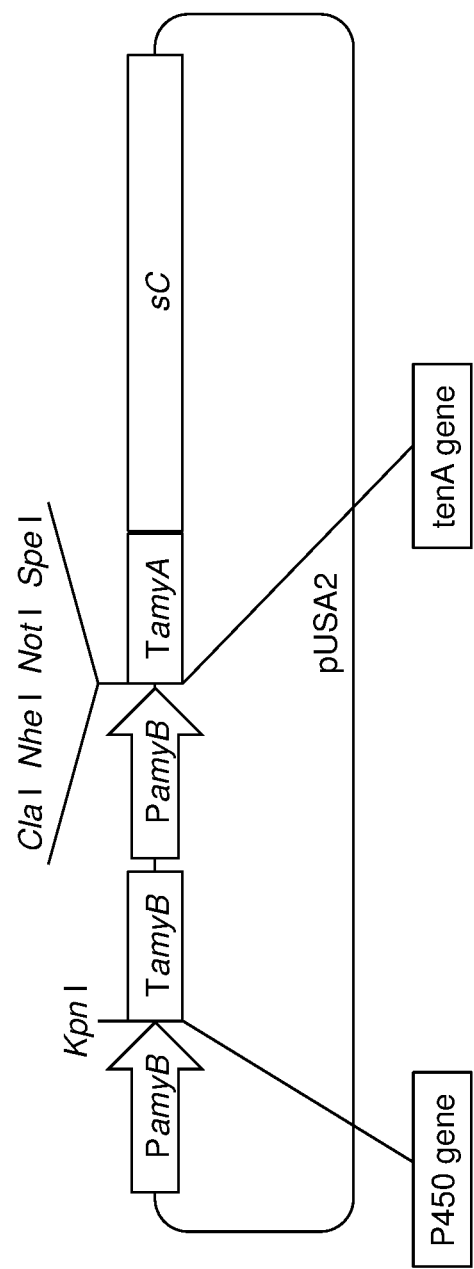
FIG. 2 schematically shows the configuration of the expression vector used in the Examples.

In this Example, a transformant was prepared by introducing the tenA gene and the P450 gene into koji mold (*Aspergillus oryzae*), and production of tentoxin was confirmed by culturing the transformed koji mold. For gene transfection, an empty vector-transfected cell line, a tenA-transfected cell line, a P450-transfected cell line, and a tenA/P450-cotransfected cell line were prepared using pUSA2 having two multicloning sites, which can be controlled with a promoter of maltose-induced geneamyB of koji mold (Tagami, K., et al., Rapid reconstitution of biosynthesis machinery for fungal metabolites in *Aspergillus oryzae*: total biosynthesis of aflatrem, Chembiochem, 2014. 15(14): pp. 2076-2080) (FIG. 2). The transfected cell lines prepared above were subjected to liquid culture in a CM medium containing, as a carbon source, 2% maltose (expression induction) or 2% glucose (expression suppression). Metabolites in the cells and the culture supernatant were collectively analyzed by ultra high performance liquid chromatography (UPLC).

<Confirmation of Production of Tentoxin and Dihydrotentoxin>

Conidia of each of the empty vector-transfected cell line, the tenA-transfected cell line, the P450-transfected cell line, and the tenA/P450-cotransfected cell line were inoculated into 30 ml of a CM medium containing 5% glucose or 5% maltose as a carbon source (100-ml baffled Erlenmeyer flask) and cultured at 30° C. and 130 rpm for 10 days. Metabolites in the cells and culture supernatant of each cell line were collectively extracted by acetone and ethyl acetate, followed by LC/MS analysis.

Figure 3:
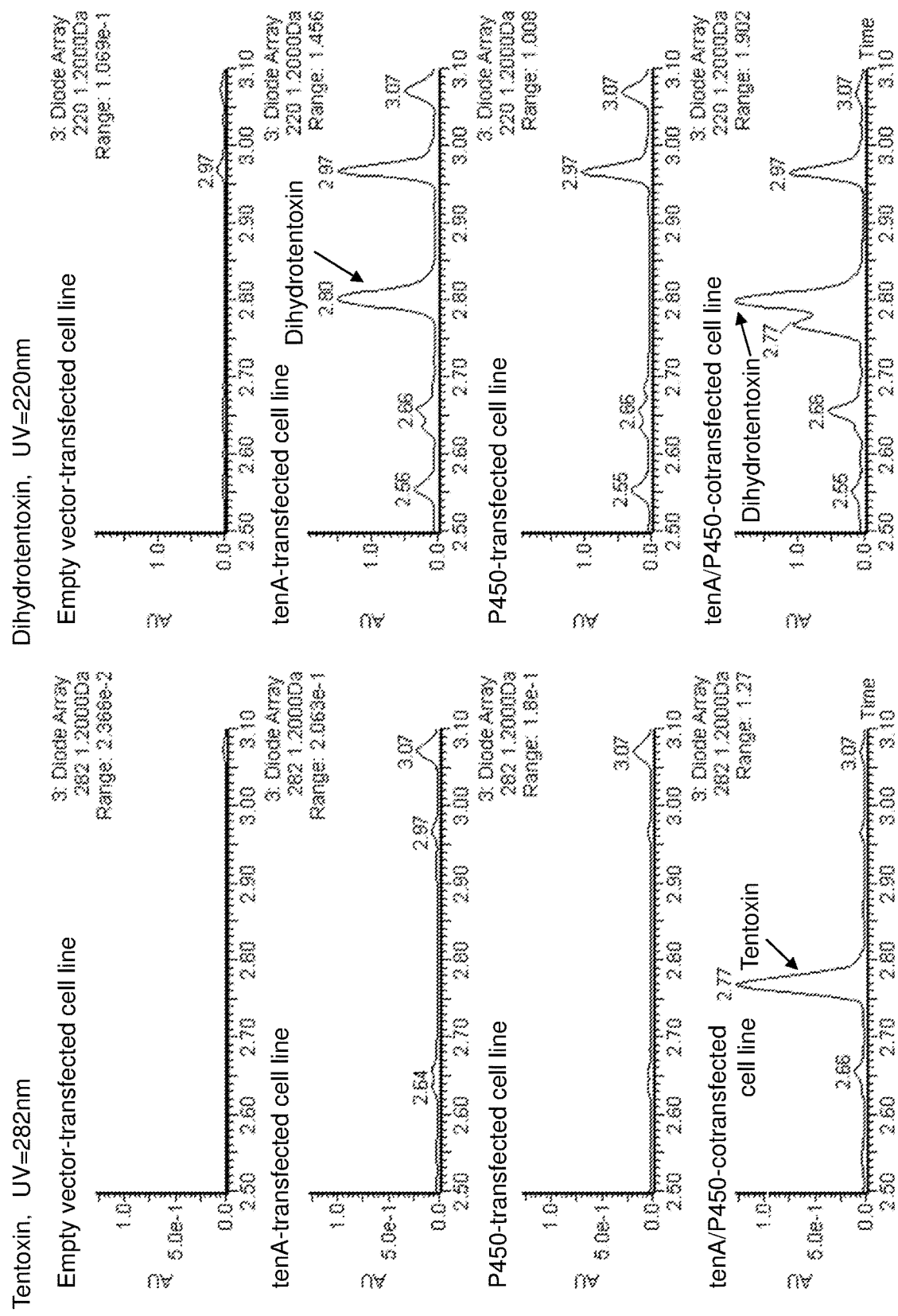
FIG. 3 shows characteristic diagrams of the results of UPLC analysis of metabolites in cells and culture supernatants of the transformants prepared in the Examples.
Figure 5:
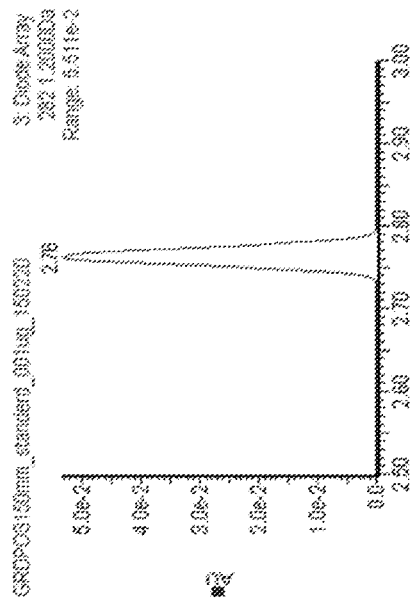
FIG. 5 shows characteristic diagrams of a chromatogram and an MS spectrum of the tentoxin preparation and an MS spectrum of dihydrotentoxin. An MS spectrum (UV=282 nm) with a peak at a retention time of 2.80 min is shown in A), a chromatogram (UV=282 nm) of a tentoxin preparation is shown in B), and an MS spectrum (UV=220 nm) with a peak at a retention time of 2.82 min is shown in C).
Figure 5:
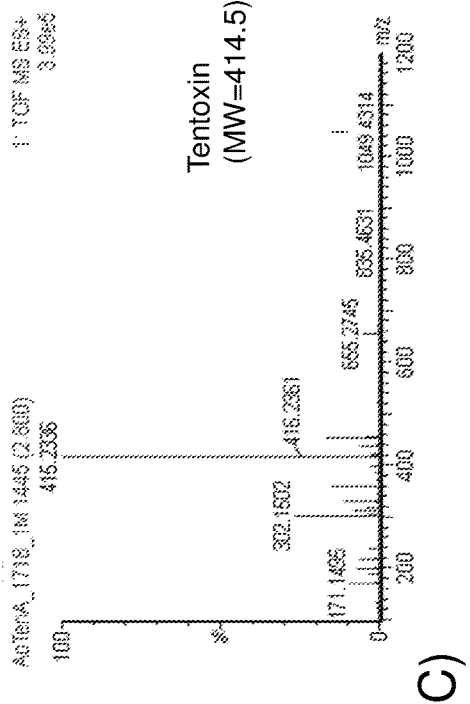
Figure 5:
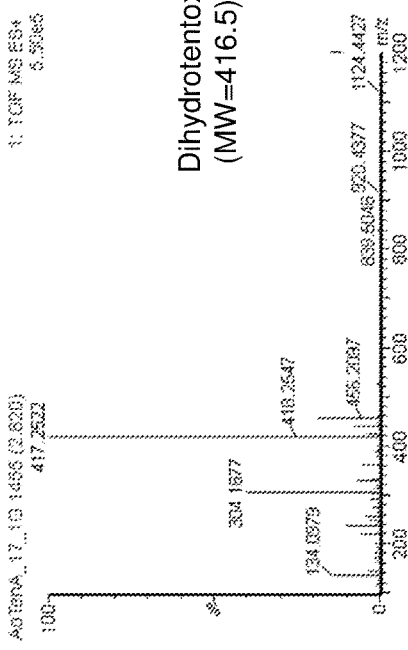

<LC Conditions>
System: ACQUITY UPLC I-Class System (Waters Corporation)
Column: Acquity UPLC BEH C18 2.1×150 mm (Waters Corporation)
Mobile phase: A/B=80/20 (0.5 min hold)→3 min→2/98 (0.5 min hold)→0.5 min→80/20
  A: Distilled water
  B: Acetonitrile
Flow rate: 0.4 ml/min
Detection wavelength: 220 nm, 282 nm
<MS Conditions>
System: Xevo G2 QTof (Waters)
Ionization Conditions: ESI, Positive FIGS. 3 and 4 show analysis results. As shown in FIGS. 3 and 4, only dihydrotentoxin was detected in the tenA-transfected cell line while tentoxin as well as dihydrotentoxin were detected in the tenA/P450-cotransfected cell line under conditions of expression induction with maltose used as a carbon source. Tentoxin was identified based on a comparison with the authentic standard in terms of HPLC retention time and MS spectral results. Meanwhile, dihydrotentoxin was identified based on the correspondence of molecular weight on the MS spectrum (FIG. 5).

The above results show that the putative tenA gene in this Example was identified as the NRPS gene capable of synthesizing dihydrotentoxin. In addition, the putative P450 gene in this Example was identified as a gene encoding an enzyme having activity of converting dihydrotentoxin to tentoxin. As a result of this Example, it was revealed that tentoxin can be biosynthesized by culturing a transformant obtained by transfecting a host with the tenA gene and the P450 gene.

Example 2

In this Example, the amount of dihydrotentoxin produced upon heterologous expression of the NRPS gene identified in Example 1 was compared with the amount of dihydrotentoxin produced upon heterologous expression of the *Cochliobolus miyabeanus*-derived NRPS gene (CmNps3).

The *Cochliobolus miyabeanus*-derived NRPS gene is a gene disclosed as a tentoxin biosynthesis-related gene candidate in De Bruyne, L., et al., Comparative chemical screening and genetic analysis reveal tentoxin as a new virulence factor in *Cochliobolus miyabeanus*, the causal agent of brown spot disease on rice. Mol Plant Pathol, 2015. 17 (6): pp. 805-817. The CmNps3 gene encodes a protein having 78% homology at the amino acid level to a protein encoded by the NRPS gene identified in Example 1. Note that the above document does not teach that the protein encoded by the CmNps3 gene synthesizes dihydrotentoxin.

In this Example, transformants were prepared by introducing the tenA gene and the CmNps3 gene separately into host cells of the filamentous fungus *Curvularia clavata* to replace the NRPS gene of *C. clavata* (hereinafter referred to as "CcNRPS") by each gene, and these transformants were cultured to examine the amount of dihydrotentoxin produced.

<Construction of Gene Transfection Vectors>

Figure 6:
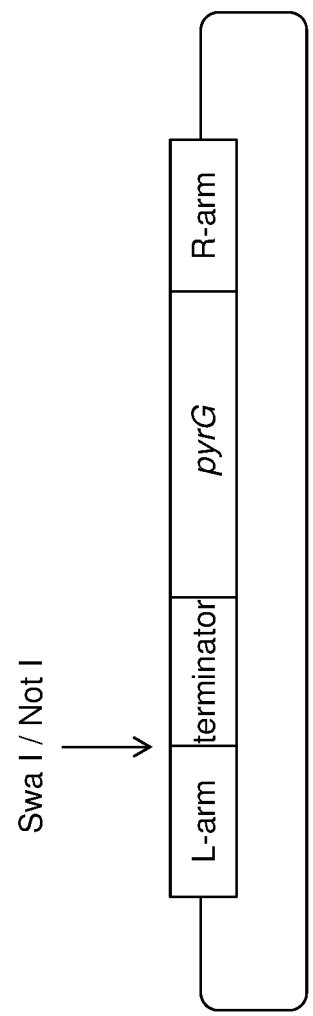
FIG. 6 schematically shows the configuration of the gene transfection vector used in Example 2.

An upstream promoter region of about 1,010 bp of the CcNRPS gene of *C. clavata* was designated as L-arm and a 995-bp region starting from the 4860th nucleotide from the 5' end of the CcNRPS gene was designated as R-arm. Both gene fragments were obtained by PCR using the genome DNA of *C. clavata* as a template. In addition, a *C. clavata*-derived 355-bp terminator region for controlling the gene of interest (tenA gene or CmNps3 gene) and the pyrG gene serving as a transformant selection marker were obtained by PCR using the genome DNA as a template. Subsequently, the resulting PCR-amplified gene fragment, in which the L-arm, the terminator sequence, the pyrG gene, and the R-arm were ligated in that order, was inserted into pUC19 using an In-Fusion Cloning Kit (Clontech), thereby preparing a gene disruption construct for each gene. Here, the restriction enzyme Swa I and Not I recognition sequences for gene insertion were designed between the L-arm and the terminator sequence (FIG. 6).

The primer sequences and PCR conditions used for PCR amplification of each DNA fragment constituting the relevant construct are described below. Note that overlapping sequences (15 bp) for the In-Fusion reaction are shown in lower case characters.

For L-Arm Amplification

```
Cc_TRAF140154_pre_Larm_FW:
                                    (SEQ ID NO: 25)
5'-cggtacccggggatcCCCACGTGCAGCTTCAAC-3'

Cc_TRAF140154_pre_Larm_RV:
                                    (SEQ ID NO: 26)
5'-ATTTAAATAGTTACAATATTCGTGGAGTATCCC-3'
```

For R-Arm Amplification

```
Cc_TRAF140154_pre_Rarm_FW:
                                    (SEQ ID NO: 27)
5'-accgtcatggatatcCTACGGACCGAGTGAGAACTC-3'

Cc_TRAF140154_pre_Rarm_RV:
                                    (SEQ ID NO: 28)
5'-cgactctagaggatcCAGAGTATTTAGTTGGAGGGATTG-3'
```

For pyrG Selection Marker Amplification

```
PyrG-mark_FW:
                                          (SEQ ID NO: 29)
5'-GATATCGCCGCTCTGCTTCATTGC-3'

PyrG-mark_RV:
                                          (SEQ ID NO: 30)
5'-GATATCCATGACGGTTGCTAGGGTC-3'
```

For Terminator Sequence Amplification

```
Cc_nmt1_pre_Ter_FW:
                                          (SEQ ID NO: 31)
5'-tgtaactatttaaatGCGGCCGCGCAGTTGCCGTTGGACCA-3'

Cc_nmt1_pre_Ter_RV:
                                          (SEQ ID NO: 32)
5'-cagagcggcgatatcCGCGACACTGTAATATTAAAGC-3'
```

PCR Conditions

Phusion High-Fidelity DNA Polymerase (Thermo Fisher Scientific, Inc.) was used for PCR. Temperature conditions for PCR were as follows: initial denaturation at 98° C. for 30 sec; denaturation at 98° C. for 10 sec, annealing at 60° C. for 30 sec, and elongation at 72° C. for 1 min with 30 cycles; and final elongation at 72° C. for 5 min.

<Construction of the tenA Gene High-Expression Construct>

Figure 7:
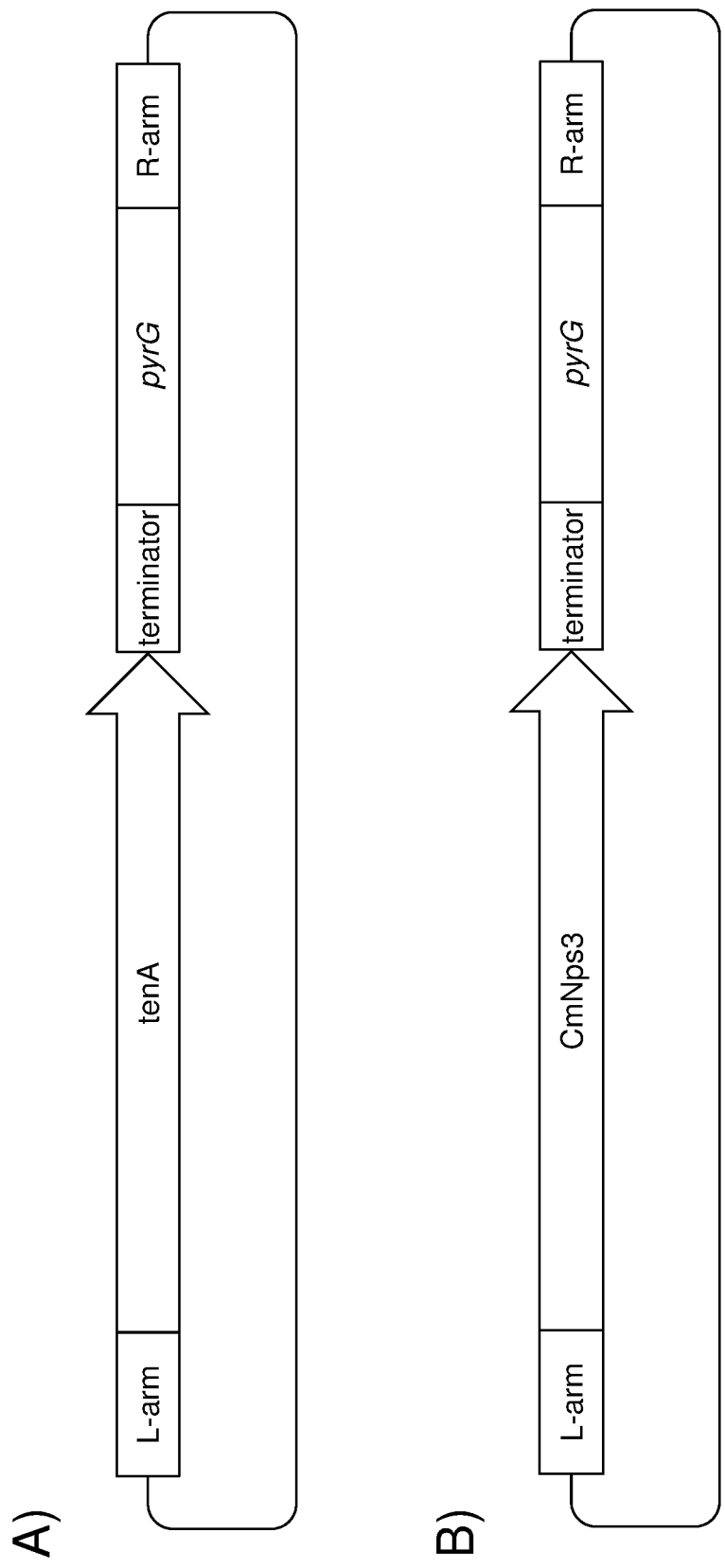
FIG. 7 schematically shows the configuration of the tenA high-expression construct prepared in Example 2 in A) and the configuration of the CmNps3 high-expression construct in B).

The tenA gene was excised from the construct prepared in Example 1 for introducing tenA into koji mold by treatment with the restriction enzyme Not I and inserted into the Not I site of the gene transfection vector prepared above by ligation. Accordingly, the tenA high-expression construct illustrated in FIG. 7A was constructed.

<Construction of the CmNps3 High-Expression Construct>

A suspension of conidia of C. miyabeanus (NBRC No. 100216) purchased from the National Institute of Technology and Evaluation (Nite) was inoculated into a PD medium and cultured at 26° C. and 140 rpm for 4 days. The cultured cells were collected using Miracloth and pressed using a spatula for dehydration. The cells were placed in a mortar that had been cooled to −20° C. in advance and liquid nitrogen was poured thereto such that the cells were frozen. The cells were quickly ground into a powder by a pestle, followed by genome DNA extraction using a DNeasy Plant Maxi Kit. The CmNps3 gene was amplified by PCR using primers, in which the restriction enzyme Not I recognition sequence had been added at the 5' end using the extracted genome DNA as a template, and inserted into pUC19 using an In-Fusion Cloning Kit. As a result of sequence analysis of the inserted sequence, nucleotides different from the nucleotide sequence of the CmNps3 gene disclosed in the above-mentioned document were found at a plurality of sites. Thus, these nucleotides were mutated by the In-Fusion reaction so as to modify them such that nucleotides could be identical to the disclosed nucleotide sequence. The nucleotide sequence of the coding region of the modified CmNps3 gene is set forth in SEQ ID NO: 33, and the amino acid sequence of a protein encoded by the gene is set forth in SEQ ID NO: 34. In other words, the sequences of SEQ ID NOS: 33 and 34 are the sequences concerning CmNps3 described in the above-mentioned document (De Bruyne, L., et al.).

Subsequently, the CmNps3 gene was excised by treatment with the restriction enzyme Not I and inserted into the Not I site of the gene transfection vector prepared above by ligation. Accordingly, the CmNps3 high-expression construct illustrated in FIG. 7B was constructed.

The sequences of primers used for PCR amplification of CmNps3 using the genome DNA of C. miyabeanus as a template and PCR conditions are described below. Note that overlapping sequences (15 bp) for the In-Fusion reaction are shown in lower case characters.

For CmNps3 Amplification

```
CmNps3(NotI)_FW:
                                          (SEQ ID NO: 35)
5'-cggtacccggggatcGCGGCCGCATGGGTGACATAGGAAAACC-3'

CmNps3(NotI)_RV:
                                          (SEQ ID NO: 36)
5'-cgactctagaggatcGCGGCCGCTCATGCCTCCTGCAGTGA-3'
```

PCR Conditions

KOD FX Neo (TOYOBO Co., Led.) was used for PCR. Temperature conditions for PCR were as follows: initial denaturation at 94° C. for 2 min; denaturation at 98° C. for 10 sec and elongation at 74° C. for 8 min with 5 cycles; denaturation at 98° C. for 10 sec and elongation at 72° C. for 8 min with 5 cycles; denaturation at 98° C. for 10 sec and elongation at 70° C. for 8 min with 5 cycles; denaturation at 98° C. for 10 sec and elongation at 68° C. for 8 min with 5 cycles; and final elongation at 68° C. for 5 min.

<Transformation of C. clavata>

A suspension of spores of the C. clavata pyrG gene disruption cell line was inoculated into 100 ml of a CM+5 mM uridine+5 mM uracil medium (300-ml Erlenmeyer flask), followed by shake culture at 30° C. for 40 hours. Thereafter, the mycelia were collected via filtration using a glass filter (11G1), washed with sterile water, and pressed with a spatula or the like for sufficient dehydration. The resulting cells were added to 10 ml of a protoplast formation solution [3 mg/ml Yatalase, 0.3 mg/ml Lysing Enzymes from Trichoderma harzianum, 0.8 M NaCl, 10 mM sodium phosphate buffer (pH6.0)], suspended therein, and gently shaken at 30° C. for 3 hours for protoplast formation. The suspension was filtered via Miracloth, the filtrate was centrifuged at 1,500×g for 5 minutes to collect protoplasts, and the protoplasts were washed twice with 0.8 M NaCl. The protoplasts were suspended in Solution 1 [0.8 M NaCl, 10 mM CaCl2, 10 mM Tris-HCl (pH 8.0)] so as to result in a concentration of $2 \times 10^8$/ml, 0.2 volume of Solution 2 [40% (w/v) PEG4000, 50 mM $CaCl_2$, 50 mM Tris-HCl (pH8.0)] was added thereto, and the mixture was gently suspended. The tenA high-expression construct (FIG. 7A) or CmNps3 high-expression construct (FIG. 7B) linearized via digestion with the restriction enzyme Sbf I in an amount equivalent to 5 μg was added to 0.2 ml of the protoplast suspension, and the mixture was left in ice for 10 minutes. After 1 ml of Solution 2 was added, the mixture was gently suspended and left at room temperature for 15 minutes. After 10 ml of Solution 1 was added, the mixture was gently suspended, the protoplasts were collected by centrifugation, the supernatant was removed as much as possible, and the protoplasts were suspended in 1 ml of Solution 1. The protoplast suspension in an amount of 0.2 ml was placed on each of five CM+1.2M sucrose selection plates, 6 to 7 ml (per 90-mm dish) of a CM+1.2 M sucrose soft agar (1%) selection medium was added and quickly spread in layers to uniformly distribute protoplasts, followed by culture at 26° C. for 6 days.

<Analysis of Metabolites>

The suspension of conidia of the tenA high-expression cell line and that of the CmNps3 high-expression cell line prepared above were each inoculated into 30 ml of a CM medium, followed by shake culture at 26° C. and 140 rpm for 7 days. Metabolites in the cells and culture supernatant were collectively extracted with acetone and ethyl acetate, followed by LC/MS analysis.

Figure 8A:
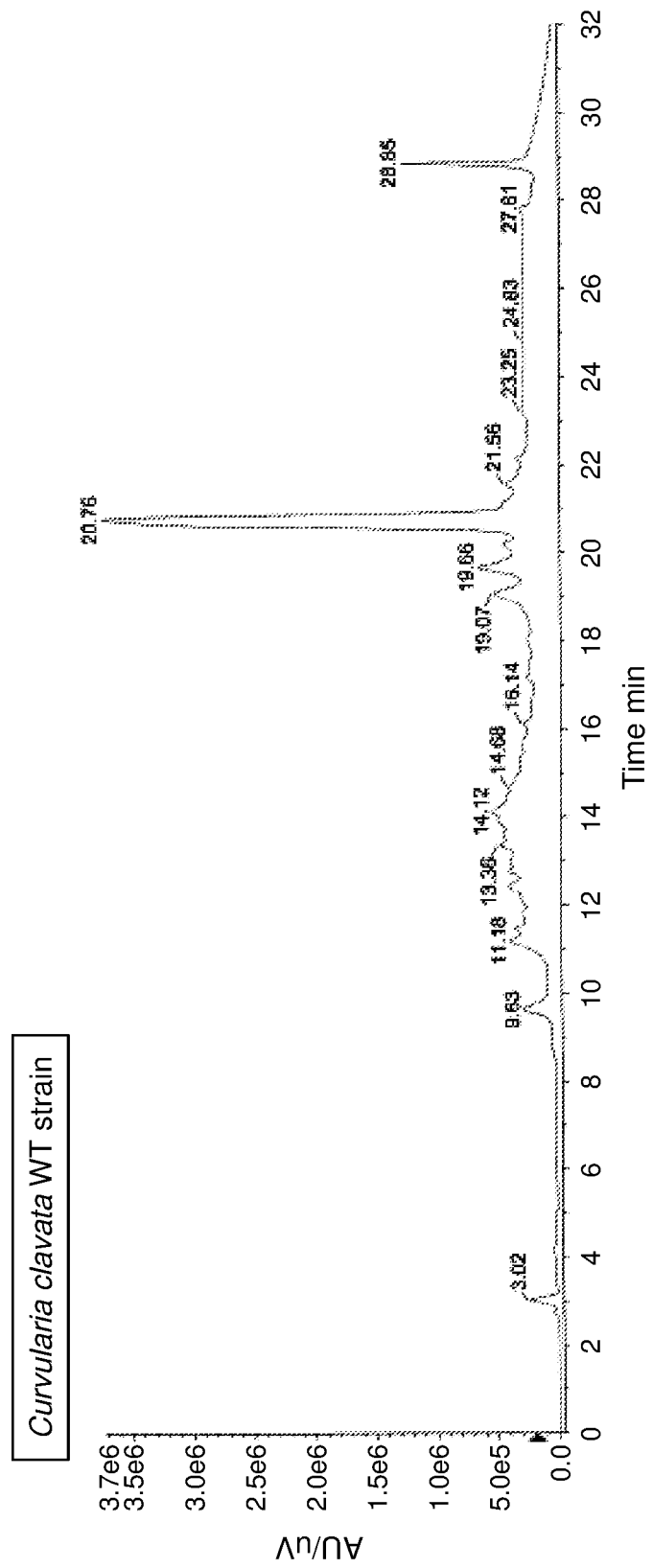
FIG. 8A is a characteristic diagram of the results of HPLC analysis of metabolites in the cells and culture supernatant of the *Curvularia clavata* wild-type cell line used in Example 2.
Figure 8B:
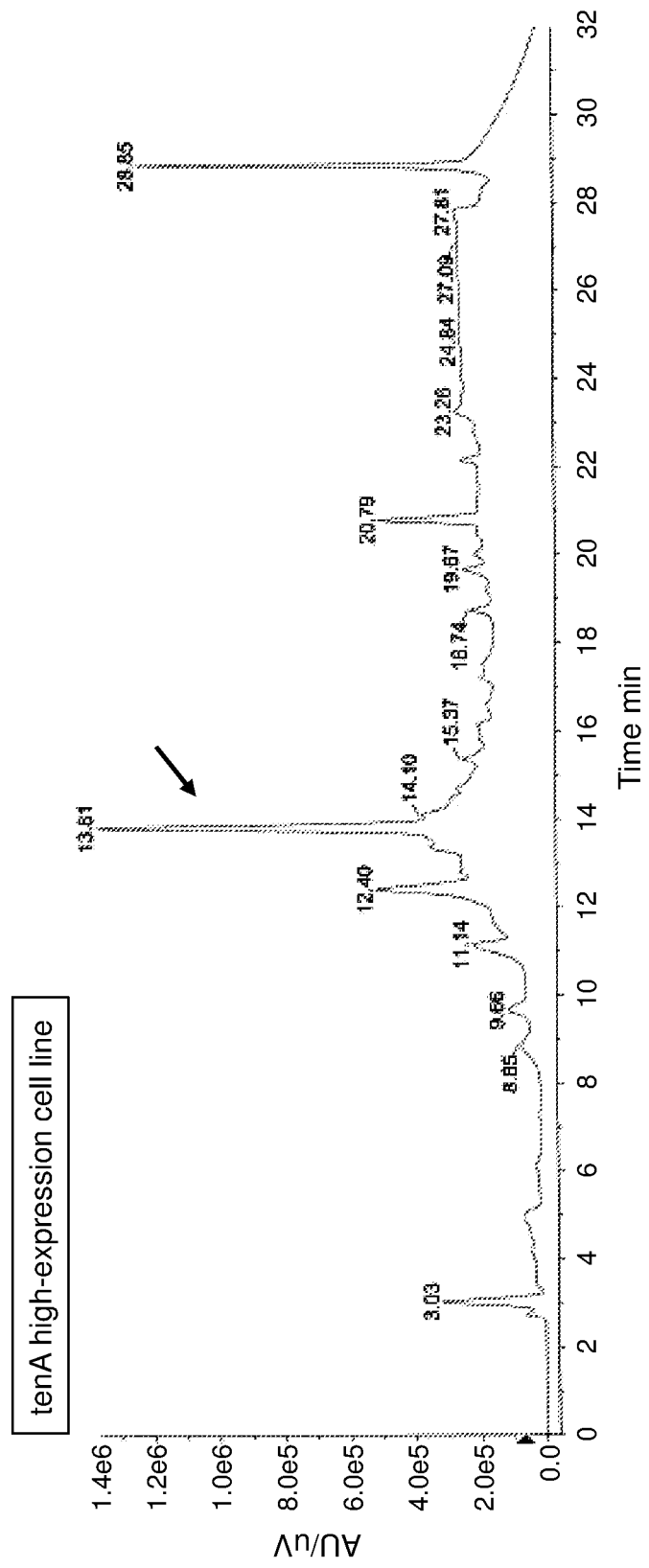
FIG. 8B is a characteristic diagram of the results of HPLC analysis of metabolites in the cells and culture supernatant of the tenA high-expression cell line prepared in Example 2.

<HPLC Conditions>
System: Prominence UFLC (Shimadzu Corporation)
Column: CAPCELL PAK SG120 5 µm, 4.6 mm×250 mm (Shiseido Company, Limited)
Mobile phase: A/B=80/20 (5 min hold)→15 min→2/98 (5 min hold)→5 min→80/20
  A: Distilled water/TFA (100/0.1, v/v)
  B: Acetonitrile/TFA (100/0.1, v/v)
Flow rate: 1.0 ml/min
Detection wavelength: 220 nm, 282 nm
<MS Conditions>
System: 3200 Q TRAP (Applied Biosystems Inc.)
Ionization conditions: ESI, positive FIGS. 8A to 8E show the analysis results. As a result of HPLC analysis, as shown in FIG. 8B, a clear peak which was not observed for the wild-type cell line (FIG. 8A) was confirmed at a retention time of 13.8 minutes for the tenA high-expression cell line. As a result of MS spectrum analysis, this peak was found to correspond to the molecular weight of dihydrotentoxin as shown in FIG. 8D. Here, the molecular weight of dihydrotentoxin is 416.51.

Figure 8C:
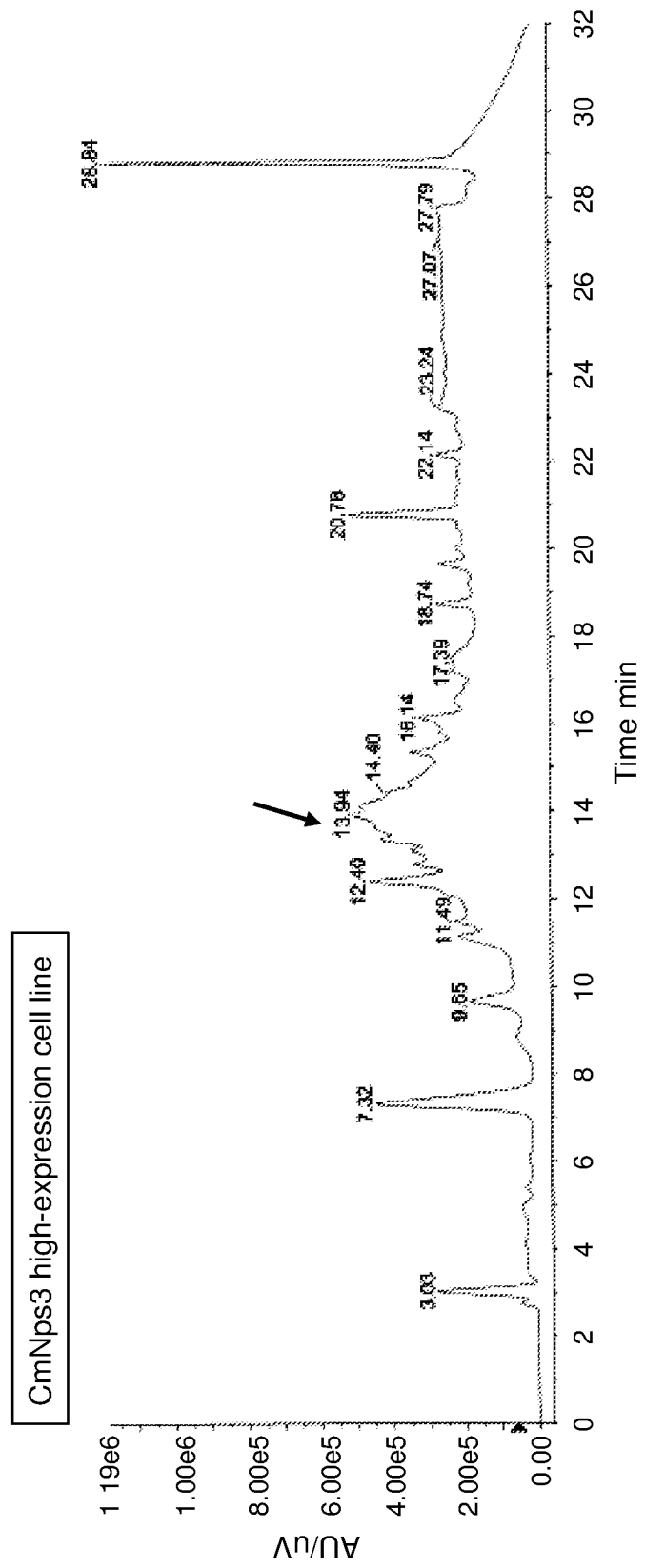
FIG. 8C is a characteristic diagram of the results of HPLC analysis of metabolites in the cells and culture supernatant of the CmNps3 high-expression cell line used in Example 2.
Figure 8D:
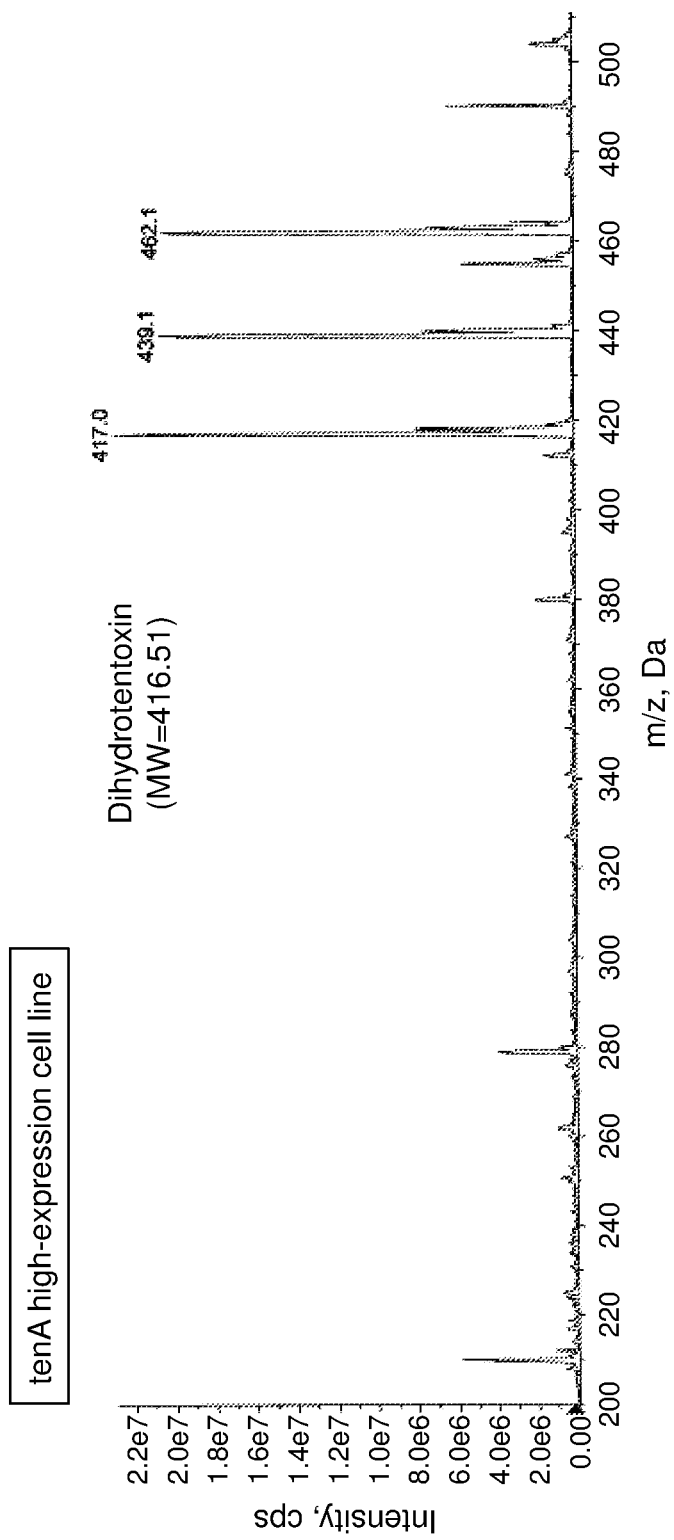
FIG. 8D is a characteristic diagram showing an MS spectrum at a retention time of 13.8 min for the tenA high-expression cell line.
Figure 8E:
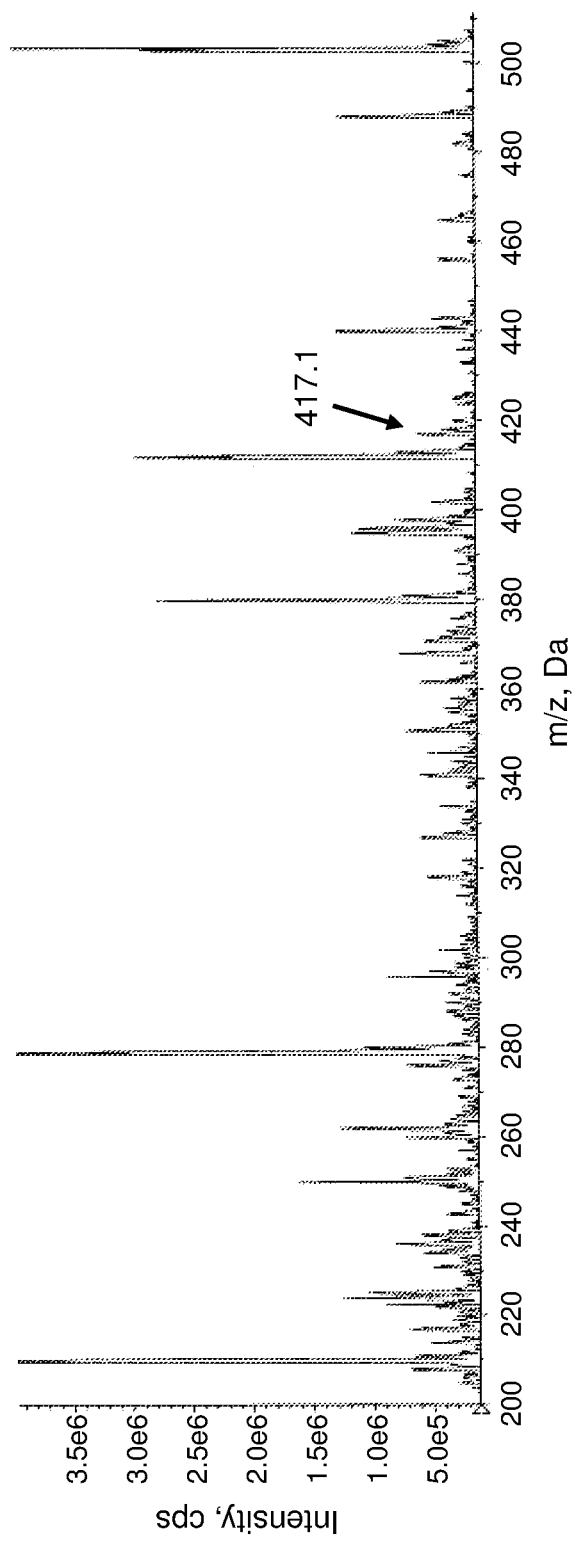
FIG. 8E is a characteristic diagram showing an MS spectrum at a retention time of 13.8 min for the CmNps3 high-expression cell line.

Meanwhile, as shown in FIG. 8C, such a clear peak was not confirmed for the CmNps3 high-expression cell line as a result of HPLC analysis. Meanwhile, as a result of analysis of the MS spectrum at a retention time 13.8 minutes, a slight peak corresponding to the molecular weight of dihydrotentoxin was confirmed as shown in FIG. 8E. The amount of dihydrotentoxin produced by the CmNps3 high-expression cell line was compared with that produced by the tenA high-expression cell line based on the ion intensity (peak area). It was found that the former was one-fiftieth the latter, which was significantly low.

Analysis using the 18S ribosome RNA gene revealed that C. clavata used herein as a host for heterologous expression in this Example is an organism closely related to C. miyabeanus compared with A. alternata. In other words, the 18S ribosome RNA gene of C. clavata, which had been originally decoded by the inventors, was found to have 47% homology to the 18S ribosome RNA gene of A. alternata (GenBank Accession No: L76146) while having 88% homology to the 18S ribosome RNA gene of C. miyabeanus (GenBank Accession No:HM130609).

In the case of heterologous expression of genes having the same function, the use of a gene closely related to a host usually results in efficient transcription/translation. In this Example, productivity was compared by conducting homologous recombination using the same gene expression construct so as to introduce each of the genes at an identical site on the genome of C. clavata. Therefore, it can be said that the use of the CmNps3 gene of C. miyabeanus that is closely related to C. clavata is more advantageous for dihydrotentoxin production. However, as described in this Example, the cell line transfected with the A. alternata-derived tenA gene identified in Example 1 was found to have dihydrotentoxin productivity at a significantly higher level than the cell line transfected with the CmNps3 gene. Based on the above results, it is understood that the tenA gene is more suitable for dihydrotentoxin production than the CmNps3 gene.

All publications, patents and patent applications cited in the present description are incorporated herein by reference in their entirety.

SEQUENCE LISTING (36 sequences)

SEQ ID NO: 1 - protein, 405 aa, Alternaria alternata
MTYEQLNQHSTRLASYLVTQGIGTEVMVPLCFEKSIWAIVAMLAVLKAGAAFVPLDPMHPRARHEEIFKQTNAKMVLTSVHYAALWPDSGLQFLAIDKTFVDQLPWETEIRSKVEPIDAVYVMFTSGSTGVPKGVVLEHRSIATSCLAHGIEMKLGPDSRALQFAAYTFDICIAEIFTTLIFGGCVCVPSEDDRRNALSEVINNNNINWAQLTPTVARLLDPSTVPSLRVLVLGGERVDDADWKRWGDDIVKVNVYGPTECSIWCTSYCNTGRNFRSGTIGTSMASFSWVTDPEDHNKLVPFGSIGELLIEGPILARGYLNDISKTEAVFIHDPLWLRQGNRKDESTRRQGRLYKTGDLVYYDADGNLVYAGRKDSQTKVRGQRIELGEIEHHLNQYMSGIKQVA

SEQ ID NO: 2 - protein, 66 aa, Alternaria alternata
KEQILHHLWAQVLSIDASSIGMDDSFFDLGGDSIAAMKLVGEARRSGIYISVAVVFQNPTLDKLTS

SEQ ID NO: 3 - protein, 297 aa, Alternaria alternata
DEPVAQSFAQGRMWFLEELHPGLTWYLMPVVVRMKGPLELAALQSALNAIENRHETLRTTFKTIGDTSMQLVHPYHAKELSIIDINTQSLEEALHRDQTTAFDLRKESGLRVSVYRISNEDHVLSIIMHHIISDGWSTDVFTRELGAFYSASIRGQDPFLHAQALPIQYRDFSVWQRQQAQIDKHQSQLRYWFNLLNTSRPAELLCDKARPAVLSGQASKQTIQIGGPLYIQLLQFCKAKGVTKFMVLFAAFRATHFRLTGQNDATIGTVNANRDRWELKDMIGFFVNLQCLRTTID

SEQ ID NO: 4 - protein, 405 aa, Alternaria alternata
MTYTQLDKESDALAQWLAKQSLAPETLVSVLAGRSCQTIVAFLAILKAGLAYLPFDVKVPAKRLSTILGSLSGLKLVFLGEDVQPPYVDISHVRFVRIAEALDEQTHEGSASRDIVKPTANSLAYVMFTSGSTGQPKGAMIEHRGIVRLVRDNNFVKHLPASPVMAHMTNLAFDVSTWEIYASLLQGGTLVCIDRMTVLDPEAVLRTFRREHVRTAFMTPSLFRTYVQQSPALFAGLDMLCVGGEALQSNDILSMKTLRTGKIINGYGPTENTTFSTTFVLSKHGQYPNGAPIGRALSNSGAYVMDLKQQLVPLGVVGELVVTGDGLARGYTDLERNIDRFITIQIGGEVVKAYRTGDHVRYRPADGQLEYLGRMDGQIKIRGHRIELGEIEHVVRSHGSVREAV

SEQ ID NO: 5 - protein, 223 aa, Alternaria alternata
DGSAIDKVEMNEWLDDTIDTMLNGHPPGKVLEVGTGTGMVLFNLGDGLESYVGLDPSSRAVEFVKDTVRSVPALADKVRVYKATATEVDRLEHIDASLIVINSVIQYFPSLEYLFKTIQQLLGLESVSTIFFGDVRSYALHREFLATRAMFMAGDSADKAEVSRMITDMELVERELLLDPAFFTALPERLPDLVEHVEILPKKMKATNELSCFRYAAVVHVKP

SEQ ID NO: 6 - protein, 68 aa, Alternaria alternata
LKIQQLIARVLRIDSDRIGLDDSFFQLGGDSIAAMKLVALARDEDIRLTVAKIFQYPKLIQLAAVAQE

SEQ ID NO: 7 - protein, 272 aa, Alternaria alternata
IEDIYPCSPLQEGLISLTVKRPGDYIMQTVLELREEVDETAFRIAWEKTVQSFQILRTRIVLHDTLGLLQAVIAEKIKWADADDLATYLARDKLSSMQLGKPLARYGLVRDTRREKKWFVWTIHHAIYDGWALNHILSAVQTAYNGAEPGKQLGFNSFIKYLRHMDEDALAEYWRTTLSDCDANVFPPLVSGVQQPVADARAEYCCPPLPKRTSNTTISTLVRAAWAIVASGYTSSDDVVFGATVTGRNAPVAGIESLVGPVIATVPVRIRL

SEQ ID NO: 8 - protein, 404 aa, Alternaria alternata
MTYKELDERSSRLATYLVDVGVKPETIVPLCFEKSMWMVVAMMAVLKAGGAFAPLDPSHPVSRHREIFKQTKANLMLTSSQYANLWSECIPTVVEITGHFIDQLTTKPCSTETAVQPMNTAYVMFTSGSTGVPKGVQLEHKAVSTSCSYQGPALGITEDTRVLQFAAYTFDACILEIITTLLHGACICIPSETQRRDDLINTINTMKVTWALLTPAVARILDPQKIVSLKTLVLGGEKVNASDCDVWSGRVRLINAYGPTECCVSCVASPDMKGLDPEPIGKPIASVGWVANPSDHNRLAPLGAVGELLVEGPNLARDYLEDAKKTEAAFIHDPLWLLRGCEGYSGRRGRLYKTGDLVYHTADGDLVYVGRKDGQVKVRGQRIELAEIEHCLYQHIPDIKEIAV

SEQ ID NO: 9 - protein, 68 aa, Alternaria alternata
YEMALQKLWAQVLNIDATSIGLNDSFFQLGGDSISAMKLVSEARNVDLVFSVQDVFQVQRLGQLANRL

SEQ ID NO: 10 - protein, 299 aa, Alternaria alternata
RPVLQSFAQGRLWFLEQLHPGLDWYLMHLAVRIEGPLQLPALQAALHAIEHRHETLRTTFSTNNGESLQEVHPFSGGRELNVINVGSNNDKILLEALERDQKTPFNLRYEPGWRISVYRINEVSHVLSIVMHHIVSDGWSVDVLKKELSALYASAIRNEDPIFCLPPLPIQYRDFSVWQRLPEQAQEHRGQLDYWINQLDGSRPAEFLYDKPRPTTLSGKAGTQRLNISHQLYNRLQIFARQRGMTPFVVLLAVFRATHYRLTNQDDATIAVPNANRSRPEVGDLIGFFVNIQCIRMKI

SEQ ID NO: 11 - protein, 409 aa, Alternaria alternata
LTYAQLDSQSEKLAKFLATKSFAPETAVGVLAHRCCQAIVAFIGILKAGLAYLPFDHKAPEKRMESIFSTIEGKKLVLIGPNIPLPGTGLKDVEFAHIVDILGANEDVEFTRNELDPTLRPTASSLAYILFTSGSTGQPKGVMVDHRGIVRLAQHDQMEHFKSSGAMAHMANLAFDGSSWEIYTCLLNGGTLVCIDATTVLDQDALLRAFTGSQIRIAFITPALLNYILAESPDTIGNLDTLLVAGDRADVDDVFRARDLVRNKVVANAYGPTENSVMSTLYILSGDENCVNGVPIGKPISNSAAYVMDSEQNLVPLGVVGELVVTGDGVGRGYTDPRRDVDRFVTVTIGHQTMRAYRTGDYVRQRPRDGEMEFFGRIDGQVKIRGNRVELGEIETVLRGHELVRDAVV

SEQ ID NO: 12 - protein, 223 aa, Alternaria alternata
DGTDIDKTEMEEWLEETIGSIHDKVGGRLGNVLEIGSGSGMILFNLGDSLKHYTGFEPSRKAVDFVTGTARSIPSLANIVEMYKATAADISKVDQPLQADLIVLNSVVQYFPSQGYLFNVIRDLLKVDGVKTLFFGDIRSYALRREFYAARALFMAGERASQEDLRHLVEDMEQIEQELLVDPGFFTSLTHRLPDLVQHVEIQPKRMRATNELSSYRYTAVVY

SEQ ID NO: 13 - protein, 67 aa, Alternaria alternata
LKVQRILSRVLGIEASRIGLEDSFFQLGGDSIAAMKIVAAAREEEIHLTIANIFQHPKLVNLATVAQ

SEQ ID NO: 14 - protein, 277 aa, Alternaria alternata
IDILPTTWMQNLFISRGVNIQPLAFNYFFLNLGTRVDASRLRRSIPTLVQHFSILRTKFVYVDGVLWQTVLRKPHVPFTEVHLDMSLEEAADTVCLEDSRTTEPLELATAFMLIRGTSNEHLLAIRITHAQYDGVCFPSFVKALFAIYSGKSVEPAHNHSTYLAYTRGKNAVSALHWRNVLHGSRMTKATPLLGPSIRHDMTPVEVQTENIIGMPQVPTGLTLASLVSAAWAKVLSQITGEEDIVYGYMVAGRNANIPAITKIVGPCLNIIPVRARL

SEQ ID NO: 15 - DNA, 15489 bp, Alternaria alternata
  CDS (1)..(15489)
atgccgggatcgctactgttagacgttaacaaactcgatgttgagaaaatatgggagagaaaccgcggaactttaccagcggtcaatcgctgcgttcacagtctgtacgaagagcaagctatagctcgaccggacgcatgcgccatatacgcatgggacggcaagatgacctacgagcaattgaatcagcattcaacacgattggcaagctatcttgtaactcaaggcatcggaaccgaggtgatggtaccattgtgctttgagaaatcgatatgggcaatcgtagctatgttagctgttctcaaggctggtgctgcgttcgtgccactagacccaatgcatccaagagcccggcatgaagagatcttcaagcagaccaatgccaagatggtccttacttccgtacattacgccgctctctggccggattcgggtttgcagtttctggcaatcgacaaaacctttgttgatcaattaccatgggaaaccgagattcggtccaaagtcgagccaatagatgctgtctatgtcatgttcacatctggtagtactggtgttccgaaaggcgtcgtcttggagcatagatcaatcgcaacaagctgtcttgcccatggaattgagatgaaacttggacctgacagccgagcactccagttcgcggcttatacgttcgatatttgtatcgctgagatcttcacgactttgatattcggcggctgtgtttgtgtcccttcggaagacgatcgacgtaacgccctatccgaagtgatcaacaataacaacatcaattgggctcaactcacgccgactgttgctcgtctactagatcccagcacggttccttctctgagagtgctcgtccttggaggagaacgggtggatgacgccgattggaagagatggggtgacgatatcgtgaaggtgaacgtttatggcccgaccgagtgtagcatttggtgcacttcgtattgcaataccggccggaatttccgatcgggaacgataggcacttcgatggcttctttcagttgggttaccgacccggaagaccacaacaaactagtgcccttcggctcaattggcgaacttctgatagagggaccgatcctggcacgcgggtacctcaacgacatttcaaaaactgaggctgtttttattcatgaccctctctggctgaggcaaggcaaccgtaaagatgaatccactcgacgacagggaagactatacaagactggtgatctggtctactatgatgcagacggtaatctggtttacgcgggtcggaaggatagccagaccaaggtgagaggccaaagaattgagttgggcgagattgaacatcatctcaaccaatacatgtcaggcatcaaacaagttgcggctgaagtcatcctaccatcaggtgaccaaggaaaagcaatggtggcagcattcgtgcagctaggtgaagagccatgtcatgcgctcgtccaccagacttctaacggtgacttggaagtgaaagtcatcttcccaaactatctggatgagttgctggtccagcgtctcccaaaggacatggtgcctgaggtatactttgccgtggcggaacttccattgacgacatccgccaaagtagaccggcagaagctacgcaagattggcgcctccttttctgcacaacaattggcccagcttcgaacttatagcgatgacccaaagcgacgaccagagactgagaaagagcagatcttgcatcatctttgggcacaggtcctgagtattgacgccagttcaatcggtatggatgacagcttcttcgatctaggcggcgattcaatagcagctatgaagctggtgggcgaagcgcgcagatcaggaatatatatcagtgtggcagtcgtcttccagaaccccacgctagataagttgacctctaaagcgatctcttcagtcgatgtgtctaataccatcattccacctgttggccatgacgagcctgttgcacaatcattcgcacaaggtcggatgtggttcttagaagaacttcaccctggtcttacctggtacctcatgccggttgttgtgcgtatgaagggcccgctggagctggctgcgctccaatctgcgctgaatgcgattgagaaccgccatgagacccttcggacgacttttaaaaccattggagatacaagcatgcagctggttcacccataccatgccaaggagctgagtatcatcgacataaacacccaaagcctcgaagaagcactgcatcgggaccagacaactgccttcgacctgcgcaaggagtccggtttgcgagtgtcagtctatcgcatcagcaacgaagaccacgtcctatctatcatcatgcaccacattatctctgatggctggtctactgatgtgttcacgcgcgagttgggcgcgttctactcagcctcgatacggggccaggacccttttcttcatgcccaagctctacccatccagtatcgagacttctctgtgtggcagaggcaacaagctcagattgataaacaccagagtcagctcaggtattggttcaatctgctgaatactagcagacccgctgagctgctttgcgacaaagctcggccagctgttttatctggacaggcttccaagcaaacgatccaaattggtggcccgctatacattcagctactccagttctgcaaagcgaaaggagtcacaaagttcatggtgctatttgcggcctttagagctacacacttccgcctcactggccaaaacgatgcaactatcggcactgtgaacgccaatcgggatcgatgggagcttaaagatatgattggtttctttgtcaacctgcaatgccttcggactacgattgacgaagatcaatcgtttgaagaactcgttcaccaagtctatggagcaacaattgcttcacttgcgaacgcagacgttccgtttgagaatattgtatccaggctcaagaacaccagagacttgtctcgtcatccccttgtacagcttgtttttgctatgcattcccagcgcaacttggggcaactgacactcgagggcctggaaacagagagcctagataatgcaccgaagtcaaggtttgatcttgaattccacttttttcagcaagaagacagcctgaagggcgaagttgtctattccaccgacatttattctccagaggcgatcgacaacatgctgtcgatcttccagatcgttctcgaggggtgcctccaagagccgaaagctgcgatcgtctccttgtcattgttacgcgacgtcgaattatcaaagctgaatagcatgggtctgatccaggttgaaaagacggattatccacgagagtcgagcgtagtcgatctgtttcgccagcaaacttccatctgtccgtccaggattgctgtaaaggacgcatcagtaaccatgacttatactcagctggacaaggaatctgacgctcttgctcagtggttagccaaacaatcgctcgctccggagacgctggtcagcgtattagcagggcgcagctgtcaaactatcgtcgcatttttggctattctgaaggcgggtctagcatatttaccgttcgatgtcaaggttccggccaaacgcttgagtacaattcttggctcactctcaggcctcaaacttgtctttttaggcgaagacgtacagcctccttacgtggacattagtcacgttagattcgtacgcatcgcagaagcgttagacgagcaaactcacgaagggtccgcctctcgggatattgtcaagcccacagccaatagccttgcctatgttatgtttacgtcagggtcaaccggtcaaccaaaaggagccatgattgaacaccgtggtatcgtgcgcctagtgagggacaataactttgtgaagcatttgccggcttcgccagtcatggcgcacatgacgaatctcgcctttgatgtctctacatgggagatatatgcttcactactgcagggcgggacgctagtgtgcatcgacagaatgacagtgttggatccagaggctgtgctacgaacatttcgtcgagagcatgtcagaacagccttcatgacaccatctctcttcaggacttacgttcagcaatcgcctgcactgttcgctggtctcgatatgctttgcgttgggggtgaagcacttcaatcaaacgacatcctttctatgaaaacacttcgcacaggcaagatcatcaacggttatgggccaaccgaaaacacaacttttagcacaacttttgtgctttcaaaacatgggcagtacccgaatggcgcgcccattggccgtgcgcttagcaattctggcgcctatgtcatggatttgaagcagcagcttgttccgctaggggtcgttggggagcttgtagtcacgggcgacggcctggcacgtggatacaccgaccttgagcgcaacatagaccgcttcataacgatacaaattgggggcgaggttgtgaaggcttaccgtaccggtgaccacgtgcgatatcgtcctgcagacggccagctagagtatctcggccggatggacggacagatcaagattcggggacatcgcatcgagttgggtgagattgagcacgttgtccgtagccacgggtctgtaagagaggccgtagctgtgatgcagcagcagcagcaaaatgaaaatgaggctgctcgactggccgctttcgtcacagtctacgagggtaacgaattggttgacgaaaagccaagcggcatcgacgaatcggagcatgtcgacgtatgggaaaaccagttcgactccaaagtctatacgccaatctctaaagtgcttcctgaggccatcgggcgagacttcatcggatggacatctatgtacgatggcagcgcgatcgacaaagtggagatgaacgagtggctagacgacacgatcgacacgatgctcaacggtcatccacctggcaaggtactcgaggtaggcacaggtaccggtatggttcttttcaacctgggagatggtttagaaagctatgttgggttggatccatcttcaagagctgtggaattcgtcaaagacacagtcagatcagtacccgcgttggcagacaaggttagagtctacaaggccacagcgacggaggtcgatcgactagaacatatcgatgcaagccttatcgtcatcaactcagtcattcagtacttcccaagccttgaataccttttcaagaccatacaacaactgctgggactagagagcgtctctaccatcttctttggcgatgtgcggtcttatgcgctacaccgagaatttcttgcaactcgggcaatgttcatggctggcgacagtgcagacaaggctgaagtcagtcgcatgataactgacatggagctggtcgaaagagagctcctgttggatccagcctttttcactgctctgcctgagcgcctgccagacctagtggagcatgtcgagattttgccaaagaagatgaaggcaacaaatgagctaagttgctttcgttacgccgcggttgtccatgtcaagccgcgcgatggacgaaagcaagaacagaagattcgacacgtggggcacgatgaatggatcgacttcagggagcacaagctagatcgccaatctctcttggcacagttgcaaagcaattccggctcatacaccatagctgtgagcaacattccgtatagtaagacgatcgtgagtcggtgtctaatcgaaacgatagacaacgcagtggcagagttgtctgatctccaagactggtactcatcagtgtgtcagcaggcacattgctcttcatccatgtctgctactgacctatatgagttggcgaaggaagccaactgccgcgttgaagttagttggagcaggcagcacacccagtgtggtggtcttgacgctatattccatcgatacccgccgcgtgaaggagagaacagggtgatgttccaatttcccaccgaccacgcagagcgacccctacacagtttgagtagcatgccactacggcaacaaaccctacagagaatccaaggacaactccaggagatgcttgaagctcagctacctgcctatatgatcccccagacagttacgttcctcgaaaccatgccaaccaatcagaacggcaagatagaccggaatgccctcacacagcgaaccgagatccaggttgcaaaaggccaggagtttcaaagagatcttactagggcagaattaaaaatccagcagttgatcgcgcgcgtacttcgcatcgattcggaccgcattggtctagatgatagcttctttcagctaggtggagactcaatcgcggccatgaagcttgttgctttagctcgagacgaagacatccgactcactgtggcaaagatcttccaatatcccaaacttatccaactagctgccgtagcgcaggagcaagttcacgttcccaatgacaacatcgtcccattctctctcctagatgacgaggttgatgcaacgcagacacaccacgaggtggcagtcaagtgtgacatcgataggggtattatcgaggatatctacccatgctccccgcttcaggaaggcttgatctcgctgactgtgaagcgaccgggggattacatcatgcagaccgtgctggagttgcgagaggaagtagatgagacagcctttaggattgcatgggagaagacggttcagtctttccaaatcctgcgaacaagaattgtcctacatgacacccttggtcttttgcaggctgtcatagcggaaaagataaagtgggcagatgcagacgacctcgctacttatctagctcgagacaagctgtcatctatgcagcttggcaagccgcttgcacgctacggtcttgttcgggacactcgcagagaaaagaagtggttcgtatggacgattcaccacgcgatatacgatggttgggcgctcaatcatatcttgagtgctgtgcaaacagcatacaatggcgcggaaccgggaaagcagcttggtttcaacagcttcatcaagtatctccgtcatatggacgaagacgctctcgcagaatactggcgaaccacattgagcgactgcgacgcaaatgtcttcccaccactagtgtctggggtgcagcagccagttgcggatgcaagagcggagtattgttgcccaccacttcccaagagaacctcgaatactactatctcgacacttgttcgtgctgcatgggcaatcgttgctagcggctacaccagctcagacgacgttgtgtttggggcgacagttactggtcgaaacgcaccagtggctggcatcgagtccttggtgggtcccgttatcgcaacagtgcctgttcggatacggttgcagagagattcgactatactggaatttcttgagacagtacagaaacaggcaactgagatgattccgttcgagcaaacgggcctacaacgaatcgccaagcttgggccagacaccgaacatgcgtgcaatttccagacgctgctaatagtgcagcctgcagaggacgccttccaatcagacgacatgtttgggacgtgggaatttggctcgggtctgcaggacttcacgacgtatgcgttgatggtgcagtgcaagctggctaaagaaggtgtcaaaatcacggctagttttgatgcgcgtttggtcgaacagtggcaagttgagagaatgctaggccagctaagcttcgtcatgcagcagctagcgcgaggagattcaagaacaagagtcatggatattggaatgcttacgcaagatgatgaacagcagctctggtcgtggaaccagaggctaccaccagctatcgatcgctgtgtctacgatctttactcggaccaagcgaagtcacagcctggagcggatgcaatctgtgcctgggatggtgtaatgacgtataaagagcttgacgagcgatcatcgcggctagcgacctatttggtcgacgtcggtgtcaaaccagaaaccatagtgcccttatgtttcgaaaagtcaatgtggatggtcgtagccatgatggctgtgctaaaagcagggggtgcctttgcgcccttagaccctagccacccagtatctcgacatcgagaaattttcaagcaaacgaaggccaacttgatgctcacatcatctcagtacgccaatctctggtctgaatgcatccccactgtcgtggaaattaccggacactttattgaccagttgacgacaaagccttgcagtactgagacagcagtgcagccaatgaatacagcgtatgtcatgtttacctctggtagcactggagtacccaagggtgttcagctggaacataaggccgtttccacgagttgctcatatcaaggaccagcgttaggtatcacggaggatacacgggttcttcaattcgctgcctacaccttcgatgcctgcatcttagagatcatcacaacactcctacatggcgcatgtatatgcatcccttctgagacgcagcgccgcgacgatctcattaacacaatcaatacgatgaaggtaacctgggcgctgttgactccagccgtcgcgagaattttagacccacagaagatagtatcgttgaagacattggttcttggcggcgagaaggtcaacgcttcagactgcgatgtttggagtggccgcgtacgactgatcaatgcctacgggcccactgaatgttgcgtctcctgtgttgcaagtcccgatatgaagggactcgatccggaacccattgggaagccgatcgcgtcagttggctgggtggctaatcctagtgatcacaatagactagcaccgctaggcgcagttggagagctgttggttgagggaccaaacctagcccgagactacctggaagatgcgaagaagacagaggcagcttttattcatgatcctctctggctgctccgaggctgtgaaggctacagtggccggcgaggtagactgtacaagacaggcgatctggtctaccacactgccgatggtgatctggtctatgtaggccgcaaagatggtcaggtcaaagtgcgtggccaacgcattgagcttgccgagattgagcattgtctctatcaacacatcccagatatcaaggaaatagcagttgaactcatctcgccgaaaggaggaaagtcgatggttgcagcattcctaaaggcaaatcccgagctgctcaatggcaagctgtccgaaagggaatctggagtatacgtcgtatacccagcccgagtagacaacgaactatctcagcgactacctggaagcatggtgcctgaggtttactttggactcaccgaattcccgatatcaacctctggaaagatagatcgaaggcgactacgcgagatcggaggctctttttcgaccgatcaactggcgcgtttacgcacacaggaaaatgagagctccaatcggaaaccggaaacaaagtatgagatggcactgcagaagctatgggctcaagtgctgaatatcgatgctacctctatcggactgaacgatagcttcttccaactagggggcgactcaatttcggctatgaagcttgtgagcgaggcgcgtaatgtcgacctagttttttctgttcaagacgtcttccaggtgcagcgactgggtcagttagccaaccgattggtcgaccctcccacatcaagtcacagtgcaatcaccagaattgatcatcagcgacccgtccttcaatcgtttgcgcaaggccgactctggttcctagaacaactgcacccaggactagattggtatctcatgcaccttgcagtacgcatcgaaggtccactccaactccctgcacttcaggctgcattacacgcaatagagcatcgtcatgaaacactaaggacaacgttctctaccaacaatggcgagagcctacaggaagttcatcctttctctggaggaagagaactaaatgtcatcaacgttggttcaaacaatgacaagattctgctagaagcacttgaacgggatcagaagacaccattcaatcttcggtacgagcctggctggaggatatcagtatatcgtatcaacgaagtttctcatgttctatcgatcgtcatgcatcatatcgtctcagatggctggtcagttgatgttctgaagaaagaattaagcgctctatatgcttccgccatccgcaacgaagatcccatcttctgcttgccacctttacccattcaatacagagacttttctgtctggcagcgactaccggagcaagctcaagaacatcgagggcagctggactactggatcaatcaattagacggaagtcggccagcagaattcctctatgataaaccacgaccaacgactctgtctggtaaagcgggaacgcagagactcaacatcagccatcagctctataacaggctgcaaatatttgctaggcaacgtggaatgaccccgtttgtcgtcctcctcgccgtattcagagccacacactatcgtttgacaaaccaagatgatgcaactatcgcagtccctaatgcgaacagaagtcgcccagaggtcggagacctgattgggtttttcgtcaacatccagtgcatccgaatgaagatccaggatgaaaccttcgaagagctattgcagcatgcctacaagacggtagtagactcccttgccaaccaggacgtaccttttgaaagtattgtctctgcattgcaaggggacagggactcttcacgcaaccctctcgcgcaggtcgccttcgctgttcactcacagcaagacatagggaagctcgatttcgagggcgtcgagacagaagccatagaaggcctagcgacctcacgattcgatctcgagttccatttcttccaggaaaagaatggtttccaaggctatatatacttctcggaggagctatttgtccccgagactatacgttcgctagcatctgtcttcaccagcatcctcgacaactgtctcgacaagccagagacacagatcgccgtagtgccactcatgaccgttgaggcccacactcagctcgaccaaatggggctcctccgcatgcatcaaacagcctatctccggaattccagcatcgtggacgtcttccgccggcaagccgctatgcaaccttcaagggtggctgtgaaggacacatcaacagacttgacttacgcacagctagattcacaatcagaaaagctagcaaagttcctagcgacgaagtcatttgcccctgaaacagcagttggtgttctagcacatcgttgttgtcaagcaatcgttgctttcattggcatcctcaaagctggcttggcctatctaccattcgatcacaaggcgcccgaaaaacggatggagtccatcttctcgaccattgaaggcaaaaaattggtcttgatcggcccgaacatcccactgccaggtactggactcaaagatgttgaattcgcccatattgtcgatatcttaggcgcaaatgaagatgttgagtttacaaggaacgaactggatcctactctcagacctactgcctctagtctggcttacattctctttacgtctggctctactggtcaacccaaaggagtcatggtcgatcatcgcggcatagtacgtctggcacaacatgatcagatggagcacttcaagtcttccggagcgatggctcatatggcaaatcttgctttcgatgggtcgtcctgggagatctacacatgtcttctcaacggaggtaccctcgtttgtatcgacgcgacaaccgtgctagaccaggatgctttgttacgcgcgttcacaggatcccagattcgtatcgctttcatcacacctgctttgctgaattacatcctggccgaatccccagatacaataggcaacttggataccctacttgtagcaggagacagagctgatgtagacgacgtcttcagggcacgagatcttgtgagaaacaaagtcgttgctaatgcatatggtccaactgagaactcagtcatgagcacactgtacattctctctggagatgagaattgtgtcaatggtgtgcctatcggaaaacctatcagtaactcagcggcatacgtgatggattcggaacagaatcttgtgccacttggagttgtcggagagctcgttgttactggagatggtgttggtagaggatataccgatcctaggcgcgatgttgatcgttttgtgactgtcacaatcggacaccaaacgatgcgagcctatcgcactggcgactacgtccgccagcggcctcgagatggggaaatggaattctttggtcgcattgatgggcaagtaaagattcggggtaaccgtgttgagctaggagagattgagactgtccttcgtgggcatgagttggtgcgcgacgcagttgttgtagcagaacaacgaaaagacaagaaccagcggctttttggctacatcacactcaaagaagacttcgagatgcttagagcgcagaacagcgatgacaaccagatacagcatgtgaacgcgtgggaacaccgcttcgataccgagacatatgcaccaatcatcggtatccagtctgagacagtgggccaagatttcatcggatggacgtcaatgtacgatggcaccgacatcgacaagactgaaatggaggagtggttggaagagaccatcggttcgatccacgacaaggttggcgggcgattgggaaacgttcttgagatcggatcaggatctggcatgatcttgttcaacctcggggatagtttgaaacactatactggattcgagccgtcaaggaaggcagtcgactttgttacaggaacagccaggtcaatcccctcgcttgccaacattgtggagatgtataaggctacagcagccgacatcagcaaagtggaccagccgctccaggccgacttgattgttctgaactctgtggttcagtactttcccagccaaggatatcttttcaacgtgattcgagacttgctcaaggtcgatggggttaaaacgttattctttggggacattcgttcttatgccctgcgccgggaattctatgcagccagagcgctcttcatggctggcgaaagagctagtcaagaggacctacgacatctggtcgaggatatggaacagattgagcaagagctgttggtcgatcctggcttctttacttcactgacgcatcgtctccctgatctggtccagcatgtggagattcagcccaagagaatgagagcgacaaacgagcttagctcctaccgctacacggcagtcgtttactctcgatcttgggagtcaccgtgcggaggactccggactatccctgacactgaatggattgatttccagaaacagggcctggaccatgactctctccagcagcgcatcaaggatgtttcaagcacacatcctctagccgtgagcaacatatcccacagcaagacgctctttggaaactgcctgctgggcgcactgggcgacggaaaggccagaaagccagtccacacggattggactgctcatataaatcgacaagctaaggggataccaagcctctctgccgttgaccttgacgagatggctaaagcagcaggctgtcaagtgcggatcagctggaacagacaatactcacagcatggcggcctggatgctatattttaccctcgtcaaatcaatggtgggagtgataaggcagggttgatgttttcattcccaaccgatcatgccgaacgtcgtcgacagaccttgagcaacaagccaatgcgacagcaactggtcaaggaagtccaacagcaattggatgagcttgtcaaatttcagctaccttcatacatggttccgcaatctatccaagtgttgaatcaacttccgatcaaccagaatggtaaagtagatcggaaagttctcatacaaagaacaagaatgcagacagaagtcagccaggaaggtctacagcgggaactaagcactacagagctcaaagtacagcgcatactatcgcgggtacttggaatcgaagctagccgtatcgggctagaagatagcttctttcaactgggcggggactcgattgctgctatgaagatagtcgctgcagcgcgcgaagaagagattcaccttactatcgcaaacatcttccagcaccctaagctcgtcaacctggcgactgtggctcagttttctcaacaggaaggtgaacagaagtccatccagccgttttaccttctctcgagaacccaaagagactttcttcttcaagccatccctgagaatacgtccaatgtgaatggagacgacatcatcgacatccttccaacgacatggatgcagaatcttttcatctcccggggcgtcaacatccaacccctggcgttcaattacttcttccttaatctggggacccgcgttgacgcctcccgcctccgacgcagcatccccactctcgttcaacacttctccattctccgaacaaagtttgtttacgtcgatggggtgctttggcaaactgtccttcgcaaaccacacgtaccttttacggaggttcatctggacatgtctcttgaagaagcagctgacactgtttgcttggaggacagtcggaccacggagcctctggagttggctactgccttcatgctgatacgaggcacctccaatgaacaccttctagcaattcgcatcacgcacgctcagtacgacggtgtttgtttcccttcattcgtgaaagcactttttgccatctactccggaaagtctgtggagcctgcgcacaatcactccacctatctggcttatactcggggcaaaaatgcagtctcagccctgcactggcgtaatgtcctgcacggttcgcgaatgaccaaagccacccctttgctcggtccaagcattcgacatgacatgactccagttgaggtccagacagaaaacatcatcggcatgcctcaagtcccgactggtcttactctagcttcgctcgtcagcgccgcctgggcaaaagttctctcacaaatcactggagaagaagatatcgtctatggatacatggtcgctggccgcaatgctaatatcccggccatcaccaagattgtcggcccgtgtctaaacatcatcccagttcgcgcacggttgcatgcaaagacaacttcgactgaactaatacgttcaattcaagaacagtacatcgcactcggtgaagcagattcgatggggtttgatgaaatagtccgcacctctacagactggccggctgatacagagtacgactccgtgttccagcaccaaaacctgaatgaacatcccgaattcgactttgaaggcaccagctctaggcttcattggtttcaaaaccctgattcggtgccttgcattcttactgtggtgtcctacccgcttggagacgggctcaggattgtggttaggggtaacgaacacatcataacgccagagagtgccgagggaatcaacaaactgctctgtgagacgattggagcgctgtcctcttcgctccattag

SEQ ID NO: 16 - protein, 5162 aa, Alternaria alternata
MPGSLLLDVNKLDVEKIWERNRGTLPAVNRCVHSLYEEQAIARPDACAIYAWDGKMTYEQLNQHSTRLASYLVTQGIGTEVMVPLCFEKSIWAIVAMLAVLKAGAAFVPLDPMHPRARHEEIFKQTNAKMVLTSVHYAALWPDSGLQFLAIDKTFVDQLPWETEIRSKVEPIDAVYVMFTSGSTGVPKGVVLEHRSIATSCLAHGIEMKLGPDSRALQFAAYTFDICIAEIFTTLIFGGCVCVPSEDDRRNALSEVINNNNINWAQLTPTVARLLDPSTVPSLRVLVLGGERVDDADWKRWGDDIVKVNVYGPTECSIWCTSYCNTGRNFRSGTIGTSMASFSWVTDPEDHNKLVPFGSIGELLIEGPILARGYLNDISKTEAVFIHDPLWLRQGNRKDESTRRQGRLYKTGDLVYYDADGNLVYAGRKDSQTKVRGQRIELGEIEHHLNQYMSGIKQVAAEVILPSGDQGKAMVAAFVQLGEEPCHALVHQTSNGDLEVKVIFPNYLDELLVQRLPKDMVPEVYFAVAELPLTTSAKVDRQKLRKIGASFSAQQLAQLRTYSDDPKRRPETEKEQILHHLWAQVLSIDASSIGMDDSFFDLGGDSIAAMKLVGEARRSGIYISVAVVFQNPTLDKLTSKAISSVDVSNTIIPPVGHDEPVAQSFAQGRMWFLEELHPGLTWYLMPVVVRMKGPLELAALQSALNAIENRHETLRTTFKTIGDTSMQLVHPYHAKELSIIDINTQSLEEALHRDQTTAFDLRKESGLRVSVYRISNEDHVLSIIMHHIISDGWSTDVFTRELGAFYSASIRGQDPFLHAQALPIQYRDFSVWQRQQAQIDKHQSQLRYWFNLLNTSRPAELLCDKARPAVLSGQASKQTIQIGGPLYIQLLQFCKAKGVTKFMVLFAAFRATHFRLTGQNDATIGTVNANRDRWELKDMIGFFVNLQCLRTTIDEDQSFEELVHQVYGATIASLANADVPFENIVSRLKNTRDLSRHPLVQLVFAMHSQRNLGQLTLEGLETESLDNAPKSRFDLEFHFFQQEDSLKGEVVYSTDIYSPEAIDNMLSIFQIVLEGCLQEPKAAIVSLSLLRDVELSKLNSMGLIQVEKTDYPRESSVVDLFRQQTSICPSRIAVKDASVTMTYTQLDKESDALAQWLAKQSLAPETLVSVLAGRSCQTIVAFLAILKAGLAYLPFDVKVPAKRLSTILGSLSGLKLVFLGEDVQPPYVDISHVRFVRIAEALDEQTHEGSASRDIVKPTANSLAYVMFTSGSTGQPKGAMIEHRGIVRLVRDNNFVKHLPASPVMAHMTNLAFDVSTWEIYASLLQGGTLVCIDRMTVLDPEAVLRTFRREHVRTAFMTPSLFRTYVQQSPALFAGLDMLCVGGEALQSNDILSMKTLRTGKIINGYGPTENTTFSTTFVLSKHGQYPNGAPIGRALSNSGAYVMDLKQQLVPLGVVGELVVTGDGLARGYTDLERNIDRFITIQIGGEVVKAYRTGDHVRYRPADGQLEYLGRMDGQIKIRGHRIELGEIEHVVRSHGSVREAVAVMQQQQQNENEAARLAAFVTVYEGNELVDEKPSGIDESEHVDVWENQFDSKVYTPISKVLPEAIGRDFIGWTSMYDGSAIDKVEMNEWLDDTIDTMLNGHPPGKVLEVGTGTGMVLFNLGDGLESYVGLDPSSRAVEFVKDTVRSVPALADKVRVYKATATEVDRLEHIDASLIVINSVIQYFPSLEYLFKTIQQLLGLESVSTIFFGDVRSYALHREFLATRAMFMAGDSADKAEVSRMITDMELVERELLLDPAFFTALPERLPDLVEHVEILPKKMKATNELSCFRYAAVVHVKPRDGRKQEQKIRHVGHDEWIDFREHKLDRQSLLAQLQSNSGSYTIAVSNIPYSKTIVSRCLIETIDNAVAELSDLQDWYSSVCQQAHCSSSMSATDLYELAKEANCRVEVSWSRQHTQCGGLDAIFHRYPPREGENRVMFQFPTDHAERPLHSLSSMPLRQQTLQRIQGQLQEMLEAQLPAYMIPQTVTFLETMPTNQNGKIDRNALTQRTEIQVAKGQEFQRDLTRAELKIQQLIARVLRIDSDRIGLDDSFFQLGGDSIAAMKLVALARDEDIRLTVAKIFQYPKLIQLAAVAQEQVHVPNDNIVPFSLLDDEVDATQTHHEVAVKCDIDRGIIEDIYPCSPLQEGLISLTVKRPGDYIMQTVLELREEVDETAFRIAWEKTVQSFQILRTRIVLHDTLGLLQAVIAEKIKWADADDLATYLARDKLSSMQLGKPLARYGLVRDTRREKKWFVWTIHHAIYDGWALNHILSAVQTAYNGAEPGKQLGFNSFIKYLRHMDEDALAEYWRTTLSDCDANVFPPLVSGVQQPVADARAEYCCPPLPKRTSNTTISTLVRAAWAIVASGYTSSDDVVFGATVTGRNAPVAGIESLVGPVIATVPVRIRLQRDSTILEFLETVQKQATEMIPFEQTGLQRIAKLGPDTEHACNFQTLLIVQPAEDAFQSDDMFGTWEFGSGLQDFTTYALMVQCKLAKEGVKITASFDARLVEQWQVERMLGQLSFVMQQLARGDSRTRVMDIGMLTQDDEQQLWSWNQRLPPAIDRCVYDLYSDQAKSQPGADAICAWDGVMTYKELDERSSRLATYLVDVGVKPETIVPLCFEKSMWMVVAMMAVLKAGGAFAPLDPSHPVSRHREIFKQTKANLMLTSSQYANLWSECIPTVVEITGHFIDQLTTKPCSTETAVQPMNTAYVMFTSGSTGVPKGVQLEHKAVSTSCSYQGPALGITEDTRVLQFAAYTFDACILEIITTLLHGACICIPSETQRRDDLINTINTMKVTWALLTPAVARILDPQKIVSLKTLVLGGEKVNASDCDVWSGRVRLINAYGPTECCVSCVASPDMKGLDPEPIGKPIASVGWVANPSDHNRLAPLGAVGELLVEGPNLARDYLEDAKKTEAAFIHDPLWLLRGCEGYSGRRGRLYKTGDLVYHTADGDLVYVGRKDGQVKVRGQRIELAEIEHCLYQHIPDIKEIAVELISPKGGKSMVAAFLKANPELLNGKLSERESGVYVVYPARVDNELSQRLPGSMVPEVYFGLTEFPISTSGKIDRRRLREIGGSFSTDQLARLRTQENESSNRKPETKYEMALQKLWAQVLNIDATSIGLNDSFFQLGGDSISAMKLVSEARNVDLVFSVQDVFQVQRLGQLANRLVDPPTSSHSAITRIDHQRPVLQSFAQGRLWFLEQLHPGLDWYLMHLAVRIEGPLQLPALQAALHAIEHRHETLRTTFSTNNGESLQEVHPFSGGRELNVINVGSNNDKILLEALERDQKTPFNLRYEPGWRISVYRINEVSHVLSIVMHHIVSDGWSVDVLKKELSALYASAIRNEDPIFCLPPLPIQYRDFSVWQRLPEQAQEHRGQLDYWINQLDGSRPAEFLYDKPRPTTLSGKAGTQRLNISHQLYNRLQIFARQRGMTPFVVLLAVFRATHYRLTNQDDATIAVPNANRSRPEVGDLIGFFVNIQCIRMKIQDETFEELLQHAYKTVVDSLANQDVPFESIVSALQGDRDSSRNPLAQVAFAVHSQQDIGKLDFEGVETEAIEGLATSRFDLEFHFFQEKNGFQGYIYFSEELFVPETIRSLASVFTSILDNCLDKPETQIAVVPLMTVEAHTQLDQMGLLRMHQTAYLRNSSIVDVFRRQAAMQPSRVAVKDTSTDLTYAQLDSQSEKLAKFLATKSFAPETAVGVLAHRCCQAIVAFIGILKAGLAYLPFDHKAPEKRMESIFSTIEGKKLVLIGPNIPLPGTGLKDVEFAHIVDILGANEDVEFTRNELDPTLRPTASSLAYILFTSGSTGQPKGVMVDHRGIVRLAQHDQMEHFKSSGAMAHMANLAFDGSSWEIYTCLLNGGTLVCIDATTVLDQDALLRAFTGSQIRIAFITPALLNYILAESPDTIGNLDTLLVAGDRADVDDVFRARDLVRNKVVANAYGPTENSVMSTLYILSGDENCVNGVPIGKPISNSAAYVMDSEQNLVPLGVVGELVVTGDGVGRGYTDPRRDVDRFVTVTIGHQTMRAYRTGDYVRQRPRDGEMEFFGRIDGQVKIRGNRVELGEIETVLRGHELVRDAVVVAEQRKDKNQRLFGYITLKEDFEMLRAQNSDDNQIQHVNAWEHRFDTETYAPIIGIQSETVGQDFIGWTSMYDGTDIDKTEMEEWLEETIGSIHDKVGGRLGNVLEIGSGSGMILFNLGDSLKHYTGFEPSRKAVDFVTGTARSIPSLANIVEMYKATAADISKVDQPLQADLIVLNSVVQYFPSQGYLFNVIRDLLKVDGVKTLFFGDIRSYALRREFYAARALFMAGERASQEDLRHLVEDMEQIEQELLVDPGFFTSLTHRLPDLVQHVEIQPKRMRATNELSSYRYTAVVYSRSWESPCGGLRTIPDTEWIDFQKQGLDHDSLQQRIKDVSSTHPLAVSNISHSKTLFGNCLLGALGDGKARKPVHTDWTAHINRQAKGIPSLSAVDLDEMAKAAGCQVRISWNRQYSQHGGLDAIFYPRQINGGSDKAGLMFSFPTDHAERRRQTLSNKPMRQQLVKEVQQQLDELVKFQLPSYMVPQSIQVLNQLPINQNGKVDRKVLIQRTRMQTEVSQEGLQRELSTTELKVQRILSRVLGIEASRIGLEDSFFQLGGDSIAAMKIVAAAREEEIHLTIANIFQHPKLVNLATVAQFSQQEGEQKSIQPFYLLSRTQRDFLLQAIPENTSNVNGDDIIDILPTTWMQNLFISRGVNIQPLAFNYFFLNLGTRVDASRLRRSIPTLVQHFSILRTKFVYVDGVLWQTVLRKPHVPFTEVHLDMSLEEAADTVCLEDSRTTEPLELATAFMLIRGTSNEHLLAIRITHAQYDGVCFPSFVKALFAIYSGKSVEPAHNHSTYLAYTRGKNAVSALHWRNVLHGSRMTKATPLLGPSIRHDMTPVEVQTENIIGMPQVPTGLTLASLVSAAWAKVLSQITGEEDIVYGYMVAGRNANIPAITKIVGPCLNIIPVRARLHAKTTSTELIRSIQEQYIALGEADSMGFDEIVRTSTDWPADTEYDSVFQHQNLNEHPEFDFEGTSSRLHWFQNPDSVPCILTVVSYPLGDGLRIVVRGNEHIITPESAEGINKLLCETIGALSSSLH

SEQ ID NO: 17 - DNA, 1569 bp, Alternaria alternata
  CDS (1)..(1569)
atggaggctgagcctctagacccatgggcgatcggttttatgcgtcgaaaccttgcaatgctgcgacaaaccccaatgtcggtagtgcttgctgctctcatcctcttagcttctatatatgtaccacgtttcaagttcaaatcgcagatggcgagatttccactcatcttagagcatctcagtagcgagcagcgacgagcaaagtttctcgcaggagcaaaagcactctacaaggacggctctcagaagtttaggggaatagcttatagaatgcaaactttagatgagcaacagattgtccttcctctttccgcattgacggaacttcgcaaagcccccgaggaggtgctatccttctacgacatgttttccaaaggcctggaagaaacctacacttacgtcgacatcaaatttctacccgaggtcgtcgatacaatcaagagggatcttacacccaagctcacgaaaatcacctcaaagatttgtgttgaggttgatgctgcgctggacacatatctcccctcccacgacaaatggacggagatcaatgtgtctaaaacagctctggatatcattgcaaaagtctcagcccacctcttcatcggaggtgatgttgcaaaagacccgggttatctcgaatgtacaaagaactttaccgtccatctgggtgaggccaccaaagcaatcaaagtcacgcgggtgtggctcagacccttcctagctccccgactaccagaggtgaagcgtcttctcgagacgaggaaaaagctaagaggttatgtcaagcgtgtgatggaagagagagaggccaagatcaaggacccggactgggtaccaccggacgacatgatgcaatggctcctcaaccgagctgaccggaaaaaggacacgttggaagactgcacagctgcccaagttcttcttatactcggaactatcaatgcatcgatgcagacattgattgccattttgcatacgctagcagtgactcccgagtatgtcgagccgcttcgagaggagattcgaaacactttgaatagcgacggatcgattccagtcagtgcgatgaaggagtttgggaaaattgacagttacttcaaggaggtgggcatgcactttccggtcattatcgaaccgtatttccgccgggttcgcaagggcttcactctgtcaaacgggcagtacctgccccccggcgtagctatagtcatagcgaacccgctcgtcacagactacaagtacgacacgtttgacggctttcgacactacaagttacgcgaggccagcgcgcaaaaggataagcctaaccatcgatggcttattgcaaatgaaactgagttccgatggggctatgataaccatgtctgtcctggcagattctatgcgcataatctgctcaagattatctttgctagaatagtcgaaaattacgatatcaagatgccaggggatgttgagggaatagaggctaggtacccaatggtggagcacgggaatgttgtcatggaaccaagagacaaacctcttctactcaggagggttaagaaccatcagggtcgcgtaggatga

SEQ ID NO: 18 - protein, 522 aa, Alternaria alternata
MEAEPLDPWAIGFMRRNLAMLRQTPMSVVLAALILLASIYVPRFKFKSQMARFPLILEHLSSEQRRAKFLAGAKALYKDGSQKFRGIAYRMQTLDEQQIVLPLSALTELRKAPEEVLSFYDMFSKGLEETYTYVDIKFLPEVVDTIKRDLTPKLTKITSKICVEVDAALDTYLPSHDKWTEINVSKTALDIIAKVSAHLFIGGDVAKDPGYLECTKNFTVHLGEATKAIKVTRVWLRPFLAPRLPEVKRLLETRKKLRGYVKRVMEEREAKIKDPDWVPPDDMMQWLLNRADRKKDTLEDCTAAQVLLILGTINASMQTLIAILHTLAVTPEYVEPLREEIRNTLNSDGSIPVSAMKEFGKIDSYFKEVGMHFPVIIEPYFRRVRKGFTLSNGQYLPPGVAIVIANPLVTDYKYDTFDGFRHYKLREASAQKDKPNHRWLIANETEFRWGYDNHVCPGRFYAHNLLKIIFARIVENYDIKMPGDVEGIEARYPMVEHGNVVMEPRDKPLLLRRVKNHQGRVG

SEQ ID NO: 19 - DNA, 15740 bp, Cochliobolus sativus
  CDS (208)..(15513)
ctgatccaacaagacaaaacagccattttcacaatgggtgacttgggaaaaccactagagctcgacatggataagggtgatgtcgacagaatatgggagagaaacttcgggatcataccagcggtcgagcattgcgttcacgacttgtacgcatagcaagcaaaagttcgacctaacgcgcctgccatctgctcatgggacggcgagatgacttacaagcaattggatgagcattcaacgcaactagcgagctacctagctggtctaggtgttgtggccgaggaaatgataccattgtgctttgagaagtcaatatggacagtggtagccatgcttgctgttctaaaagctggcggtgcatttgttccgctagatccatctcacccaaggtctcgccacgaagagatatttaaacagactaaagctaaggtggtacttacttccgcacaatacgcgaatctttggccaaattcaacgcaacagattcttgcagtcagcaacgccttgatcaaccagttatcagtcgagactaaagtttgttccaaagtcgagccatggaatgctgtatatgtgatgttcacatctggcagtactggagttccgaagggcgtcgtcttggagcatggagcaatcacgacaagctgtctagctcacgggaaagcaatgagacttggtcccaactctcgagccctccagtttgcggcttatactttcgacatttgcatcgctgagatattcactacattgatatttggcggatgtgtttgcattccctccgaagacgaccgacgtaacgccttgccagaagtcatcaacaacaacaatatcaactgggcgcaactcacgccaacagtcgcgcgtctacttgatcccctaacagttccgtccctaaaagtgctcgtgcttggaggagaacgagtggacgaagccgactggaaaagatgggatcacagtgtcgtacaaataaacgtttatggaccaacagagtgtagtatttggtgcactttccatgaaaacactggtctggacttccagtcagggatgatcggcagatcaatggcttcagtcagctgggtgactaacccggacgaccacaaccagctggtaccctttggtgagattggagaacttctagtagagggaccgattctagcccgtggctatctcaacgacacattgaagactgaggctgccttcgtcagcaaccccccctggctgatgcagggcagcgacgaccgtaccggacggcagggaagattgtacaaaactggagatctagtctactataatgaaaatggtgacttggtctatgtaggtcgaaaagatagccaagtcaaggtgcgcggccaacgagttgagttgggtgagattgagcaccatctccaccaatgcatgccaggcgtcaaacagttggcagctgaggtcattttacctacgggagaccagggtaaagcaatggtggcagcgtttctgcagctgagcgaagagacgcatcacacactcatcagccagatttctgacagcgactccgaagtgcaagtcatctttccaacccaagtggacgagcagctggttcagagactaccaagaaatatggtgcccgaagtatactttgcagtgatggaaattccattaacaacgtccgccaaagtagacaggcagcgattgcgtaaaattggggcatcgttttccacgcaacagttggcccagttgcggacacgaggcgatagtctaaagcgacaaccaaacacagaaaaaggaaagacactgcagaaactatggtcgcagatacttagcattgattcagagttcatcggtatggacgacagtttcttcagcctgggcggcgactcaatcgcggctatgaagctggtgggcgaagcacgtaggtcagggatacagatcagcgtcgcagtcgtcttccgcaatcccacgctggatcagttgacctctgcagcagttgcttcggctggcggctctactgctgccattccgcatgttggaagtggtgggcctgttgcgcaatcatttgcacagggtcgaatgtggttcttggaagaactacaccctggtctgacatggtatctcatgccagttgtggtgcgcattcggggcctattgcagctctctgctctagaatctgcgctaaatgcgattgagaaccgtcatgaaactctccggacaactttcgaaactattggagatgcaagcatgcaggtggttcagccgttccatcctagggtaatgaacgtcgtcgacgtagacgaacagggcctcacagatgctgtgcaccgagaccagacaactccctttgacctacgcactgaggctgggtggagagtttcgatctatcgcatcagcaaagaagaccatgtgctgtcgattgttatgcaccacattgtctctgatggctggtctactgatgtacttacacgagagttgggcgtattctactcagcctcaatacaaggccaggatccgctttcttgtgtgcaacctctgcctatccagtatcgggatttttcagtgtggcagagacaacaagcccagattgacaatgaccagagtcagctcgaatattggtccaatcagctgaataccagcaggccagctgagctgctgtgcgacaaaccccgacctactgctttatctggacaggccggaaagcaaaggcttgatatcgatggcccactctacagtaaactgcagcaattctgcaaaactcacggagtaacacagttcatggtcctatttgcagcctttagagctacacacttccgtctaactggtcagaacgatgcaactataggcactgtgaatgccaaccgagatcgatgggagctaaaagatatgatcggcttctttgtcaacttgcaatgccttcggactacaattacggacgagtcattcgaagaactggttcagcaagttcatgaagtaacgattgcttcccttgctaatggagacgttccattcgaaagcatcgtctctaagctaaagaacacgagagacatgtctcgtcatccgattgtgcagctcatctttgccgtgcactcgcagcgcaagttaggacatctgacactagagggcatggaaacagagagtcttgacaatgcaccaaagtcaagattcaatattgagttccacttcttccaacaagaagacagcctaaagggtgatgttgtctattcaagcgacctttatacaccagagacgattagcaatatgctgtcagttttccaaatcattcttgaggggtgcctccaagacccgaaagctgaaatcgcctccttaccgttgttgcgcgaagccaactactccaagctcaaagacttgggtcttattcatgttgaaaggactgattacccacgtgagtcaagcatagtcgatctcttccgtcagcaagtatcaatctgtccatccagaattgctgtcaaagacccgctggtagagatgacttatgccgagcttgaaaaggaatctgacgttctctcttggtggctagctaaacagtcgttcgctccagagacattgataggcgtattagcaggtcgaagctgccagaccattgttgcctttttaggtatcttgaaggccggcttggcgtacctaccgtttgatgtcaaactaccagcgaagcggatggaaactattctttcctcactaccaggccagaaagttgtgcttttcggggctgacctacagcctccgaacatgaagatcggtaatgtccggttcgtacgcatcacagaagccctcgacgagcagattggcgaatcatccgattctggaaacatcgtcaagccttcagcaactagcctcgcctatgtaatatttacatcggggtcaacaggtcagccgaagggtgccatggttgaacatcgcggcattgtgcgcttagtaagagacaacaactttgtgcagcatctgccagcctcaccagtcatggcgcatatgacgaatcttgcattcgatgtctccacgtgggagatatacgcttctctcctacaaggtggaacactaatctgcatcgacagaatgacagtgttggatccagaggctgtgttgcgaacattccgtcgagaacaagtccaaacagcatttatgacaccgtccctcttccgaacctaccttcagcaatcacctgcaatgtttgctaatctcgaaatgctttgtgtcggtggcgaagcacttcaatcaaatgatatcctttccataaagacacttcggacaggcacgatcatcaatggctatgggccgactgaaaatacaactttcagcacaattttcgttctatcaaaagacgaccagtacgcaaatggcgtgcccattggccgtgcgcttagcaattctggcgcctatgtcatggattcgaagcagcagcttctcccccttggcgtcgttggagagcttgttgtcacgggcgatggcctggcgcgtggatacactgatcctaagcgcaacattgaccgctttgtcacagtcgagattgacggtgagaatatgaaagcttaccgtacgggtgattacgtgcgttatcgtcctacagatggccaactggagtatttcggacgaatggacggacaggtcaaaattcgaggacatcgcatcgagttaggcgagattgagcacgttctccgcagccataagtctgtaagtgaggccgtggctgtagtgcagcagcaaaatgtagacgaggctgctcgactagctgcgttcgtcacagtctacgagggtgacgtaatagttgacgaagagcctaacgacaacgacgagtcacagcatgtgaacacatgggaggatcagtttgattcgaaggtctatatgcccatttccaatgtcctccctgaagctattggacgagacttcattggatggacttccatgtacgatggcagcgccatagataaggcggagatgaacgaatggctggacgaaacaatcaacacaatgctcaacggcggtaaacctggcaaggtccttgaggttggcacaggaactggtatgattctgttcaacttaggcgacggcctagaaagctacattggactagatccatcccaaaaagccgttgatttcgtcaaagacacagccaggtccatacctacactggcagacaaggtcagagtctacaaggccacagcagcagaacttgatcgcctaccgcctattgatgcaaatcttgttgttatcaattcagtcgttcagtatttcccaagtctggattaccttttcaagaccgtgcaacatctgctcgagatagagggcgtctctactcttttctttggtgatgtccggtcttatgcgctacatcgggagtttctcgcaacgcgtgccttgttcatggttggagacagtgcagaaaaggataatgtccgtcgcatgattgccgacatggagcgggtcgaaagagagtttctggtggacccaggtttcttcactgctctgccagagcgcctaccggatcttatcgagcacgtcgaaatcttgccaaagaaagtaaaggccacaaatgagctgagctgctaccggtacgccgccgttgttcatgttaaatcgcgacatggacaaaagcaagagcaggtgattcgacacgtgggacacgacgaatggatcgattttgctaaacacaagcttgaccgcccgtctctcttgaagcgacttcagagcctttccagctcatccactatagctgtgagcaatattccttatagtaagacgattgtgagccgatgccttatcaactcgttggaagatgccgtagcagagacgcctgattcgtcaaactggctctcgtcagtgtaccagcaagcagaacactgcccctctttgtctgctgttgatctacatgagttagcggcagaggccaattgccgtgttgagattagttggaacagacagcactcccagcgcggtggcctcgatgcgatattccatcgctgcctgccacaaaagggagagaacagagtaatgtttcaattccccaccgaccacgcagagcggcccctacacagcctgagtagtacaccgctacggcaacaggtcttgcagagaacccaaaagcagctccaggagatacttgaagcccagctacccgcttacatggttccccagacaatcacgttcctagacgcaatgccaaccaaccagaacggcaaggtggaccgtaccgctcttacacagaaaacggagattcagacagtagaaggccaagaattccaaagagaactgactagggcagagctcaaagttcagcaactgatggctcgcgtacttcgcatcaacgcaaaccgcattggcctagatgatagctttttccagctaggcggcgactcgattgcagctatgagattggttgctatggctcgtgaagaagatatccagattacggtcgcaaaagtcttccagtatcctaaacttattcaactagccgctgtagcccaggagcatgtctacgttcctagcgacaacatcgtcccattttctctaatcgaccctgaatttgatacaacgcagatacaccaagaggtggcggctagttgcaaagtcgacaggggtcttgttgaggatatctacccatgctcgccactccaggaaggcttgatgtcgctgactgtgaagcggccaggcgattacatcatgcagacagtgctggaactgcggccagatgtggatgaagtagcctttcgaagtgcatgggagaaagcagttcagtcattacaaatattgcgaacacgcatcgtagtacacaagacgcttggtttgttgcaggctgtggtgacggacaaaatgaagtgggcagaagcagacgatctgactacttacctatctgaagacaagctatcatctatgcagcttggtgagccacttgcacgctatgctctggttcgagactctcgtagagaaaagcggtggttcgtatggacaattcaccatgctatatacgatggctgggcgctgacccacattttgaacgctgtgcaaatggcatatgacggcgcagtgccagagaagcagcttgggttcaacaacttcatcaagtatcttggccagctagatcaagatgctctcgcagcctactggggggctacgcttagcgactgcgaggcgaatgttttcccaccactacaatctggggtacaacagccagttgcggatgcaacagcggaatatcaatgccctccgcttcctaaaagaacctcaaatactacaatatcgacactcattcgcacagcttgggcgattgttgccagcggctatacgagctcagacgacgttgtgtttggagcgacagtcacgggtcgaaatgcaccagtggctggcatcgagtccctggttggacccgtgattgcaacagtgccagtacgaatacgtctacagagagatctgactgttctagaacttctcgaatcggtacagaaacaggcaacagaaatgattccgttcgagcaaaccggcttgcagcgaatcaccaagctagtaccagaagcccaacatgcctgtagcttccagacgctgctgattgttcagcctgcagaagacgcattccaaacagacaacgtgtttggaaagtgggaatttggctcaggactacaagacttcacgacgtatgcgctgatggtacaatgcaagctggctaaagagggggtcaaaatcacggccagctttgatgcgcggttggttgaacagtggcaggttgaaaatatgttggctcaattaagcttcgtcatgcagcagttggcccaaggagacctaagcacaagagtcagggacattacaatgctcacgccaagtgacgaacaacagctgtggaagtggaatcacaagctaccgccagctattgagcgttgtgtccatgatctatacttggaacaggtaaattctcaacccaaagcagatgcaatatgtgcatgggatgggagaatgacatatgaagagctggacgaaacatcatcgcgccttgcacaccatttgaccagccttggggttaaaccagagagcatagtgcctctttgctttgaaaaatcgatttggatggttgtagctatgctggctgtgctcaaagcagggggtgcctttgcgcccctggatcccagtcatccaacatcgcgtcaccaagagatcttcgaccaaaccaaagccaagatagccctcacctcgacacagtacgccaacctctggccagaactttctcaaattgtcttatcaatcagcacagacttcattgatcagttgccgaccaagctttacgacgcccagatagcggtacagccaggcaatacagcgtatgtcatctttacatcgggaagtactggagtgcccaagggtgttcaactagagcataaggccgtttccacaagttgcttatgccaaggacctgctttaggaatcacaaagaatactcgagctcttcaattcgctgcctatacatttgacgcctgtattctagagattattacaactttagtacatggtgcttgtgtatgtattccttctgagagccagcggcgcgacaatctcatcgacacaatcaatgcgatggaggttagctgggcactgttgactccagccgtcgcgagaatcttggacccacagaagattttatcgctgaagacgttggttctcggtggtgaaaaggtcaatgcttcggactgtgacatctggagtgaccgcgtacaactgatcaacgcttatggacctacagaatgctgcgtctcttgtgtcgcaaatcccgatatgaaggggcttgatccggaacctatcggaaagtcagttgcatcagtcggctgggtaactaatccggacgatcacaataggctagctccgctaggcgcagtgggcgaactgttgattgaaggaccaaacttagcacgcggctatctgaacgatgcaaagaaaacagaaaccgcctttattagtgaacctccctggctacttcgaggcagtgaaggccataatgggcgacgaggcagactgtacaaaacaggtgacctggtttattacaccatagatggtaatttggtctacgtcggccgcaaagacaaccaggtcaaagtgcgtggccaacgtattgagcttgctgagattgagcatcatctctatcaatgcatgccagacatcaaagagatcgcagtcgaagtgattttaccaacaggagggaagccggtagtagcagcgttcctggaagcgaattccgagctacttaacagcaagaagtctgatgggggctccggagtccatgttgtgtttccagcccaagcagacgacgagctgtctcaacggttaccccgggatatggtgcctggggtttactttgcgctagtagagttcccaataatgacgtctggtaagatcgaccgaaagcgactacgtgagattggatgctcgttttcagcccagcaactagcccagttgcaaacacagagagacgagggtttaaaacgacagccagagacagagcaagagaaggtgttgcaacagctatgggcgcaggtgctaggtatcgacgctacttctattggactcgatgatagcttcttccgactaggtggcgactcgatcgcggctatgaagcttgtgagcgaggcgcgcaatgttgacctgaagctttccgttcaggacgttttccaaacgcagcgactcggtcaactggccaaacaatcacttcactcctccactgagagtgtaatcacaaaaggcaatcatcgggggcctgtcactcaatcgtttgcgcagggccgactttggttcttagaacaattgcatccaggactagactggtacctcatgcaccttgccgtacgcatcagaggcccacttcaactccaagccctccaagctgcgttacagactgtagagcgccgccacgaaacgctaagaacgacgttttctaccaccaatggcgaaagtcttcaggaggtccatcctttccgtgatggaaaagacctaaatgttctcgacatcaactcaaacgatgacaaagttgtgctagaaaccctggaattggaacaaaagacacctttcaatctgcgaagcgagcctggatggcgagtaaccgtctataggattaacggagatcatcatgttctttccatcgtcatgcatcacatcgtttcagatggctggtcagtcgatgttttgaagaaagaactgagcacactgtatgctgcagcagttcgcggtgaagacctgaattcctgcttaccgcctttacccatccaatatcgtgacttctctgtctggcaaaggctgccaggtcaagttcaagagcatcaacgccagcttgattattggatcaaccagttggactcgagccggccagcagaatttctctatgataagcctcggccagctactctttctggcaaagcaggcacacagaaactcaccatcagccacaaactctatgaaaggctacaaaattttgctagagaacgtggggtgactccatttgttgtcctcctcactgttttcagagccgcgcactaccgcctgactaaccaggatgacgcaaccattggagtccccaatgcgaaccgaagccgctgggaggttggagacttgattgggtttttcgtcaatattcaatgtctccgaatcaagattcaggatgaaacctttgaagagctggtgcaacaggtctatacgacagtggtagactcgcttgctaaccaggatgtaccctttgagagtatcgttgctgcattgcaaggagaccgagacatttcccgcaaccctcttgcccaggtcgcattcgctgttcactcacagcaagacatagggaagttttcgttcgatggtgttgaaacagaagtcatggagggcttagctacttcccgttttgacctcgaattccatttcttccaggaaaagaatagtctgcaaggttatatatacttctcagaggagctctttgctcctgagagtatacgttcgctagcatccatctttacaagcatccttgacaactgtctcgccaagccagaaacgcagattgcggtagcgccactcatgaccgaccaagcccacattcagctcgatcagatgcggctcctcggcatgaatgagatggcctattcccgagattcaagcattgtcgacgtcttccgccagcaagtcgctatgcaaccatccagaattgctgttaaagatgcattggcagagctaacatacgccgagctagacgcacagtcagagaagcttgcaaaatacctggcgacgaaagcgtttgctcttgaaacggcagttggtgttctggcacatcgaggctgtcaagcaattgttgcttttttcggtattctcaaagccggattagcctacctgccattcgattcaaaagcaccggaaaaacgaatggaatcgatcctttcaaccattgaaggaaaaaagctagtcttaatcggcccaaatatccagttgcccggtacagaactcaaggatgttgagtttgctcacattgtcgacatcttgaatgcagatgataatgctgagttcacaagaagcgagcttgatcctgctctcaaacctagtccttctagcctcgcttatattctatttacgtctggctctactggtcaacctaagggagtcatggtcgaacatcgtggcatagttcgcctggcacaacacgaccagatggaacacttcagatcatccgaagccaccgctcatatggcaaatcttgcttttgatggatcttcctgggagatttatacttgtcttctgaacggaggaactctggcttgcattgatgcgacaactgtactggaccaggatgccctattgcgcgccttcagggaattcaagatccggatcgctttcatcacacctgctttgctgaaatacatcctagctgaatccccagatacaattggccacctggataccctccttgtagcaggagatagagccgacatagacgacttctttgccgcacggaaccttgtgacaaacaaggtcgtcaacgcttatggccctactgagaactcggtcatgagcacactatacatactctctgatgatgaggattgtgtcaacggtgtacctattggacgatctatcagtaactctggggcatacgtgatggatccagaacagaaccttgtaccacttggtgttgttggagaactcgttgttacgggagatggtgttgccagaggatataccgatccaaatcgcaatgtcgaccgtttcgtgactgttacagtcggaaatcaaacagtgcgagcctaccgtacaggagactatgttcgccagcgacccatagatggggaaatggagttcttcggtcgcatcgatggacaagttaagatccggggcaaccgtgttgaactaggagagatcgagagcgttcttcgtgggcacaactttgtgcgcgacgcagtggtagtagcagaaaagcaacaagagaaagaccagcgacttttcggttatgttacgctcaaagaaggatctgaaatgccttccgggaagaacagcgatagcaaccaaatacagcatgtcagtgcgtgggaagaccgcttcaacaccgagatatacgccccgatcagcagtattgagtctggaacaatcggccaggattttatcggatggacctcaatgtacgatggctctgatattgacaaggcagagatgaaggagtggctgaacgaaactatcaatgcaatccacaccaaagccggtggacgattaggaaacgtacttgaagttggatcaggatccggtatgattctcttcaacctcggaaataccctagaacgttataccggatttgagccctcaagaaaggcagtcgacttcattatggggacagccaggtctatcccttcactcgccaataaagtggagatgtacaaggctacagccgctgacatcagtcaagtgaatccgccactccgggctgacacggtgattctgaactcagttgtccagtactttcccagccaggagtatctcttcaacgtagttcgagatctgcttcaggttacaggggtcaagacattgttctttggcgatatccgttcccatgctctgcgccgagaattctttgcagccagagctctctttatggctggtgaacgggctagcaaagaggaactacgacgtatgatggaggatatggaacaaattgagcgggagctgctggttgatccgggcttttttacttcattagcacgtcgtcttcccgatttggtccagcatgtggagattgagcccaagcaaatgaaagcgacaaacgagctgagctcctaccgctacacagcggtggtttactcccgatcgtggagtccgccgtccggagcgcttcgaactatccctgacaatgaatggatcgatttcaaagaacagaacctggaccatggatctcttcggcagcggataaaggatgtttcaagcacacgtcctatagccataagcaatataccctgcagcaagactatctttggaaatctccttctaagctttttggaagacgagaaagccagaaagccagtccacatggactggtctgttctgattgaccaagaattcaagcgaatgcccagtctttctgccgttgatctggatgagatggccaaagaagtaggctgtcgggtgcagatcggctggaacagacaatattcacagcagggtggcctggatgctatcttctaccctcgtcaagtcaatggtgatattaacaagtctgaattgatattttcattcccaacggatcacacggaccggccacagcaaaccttgagcaataagccaatgcggcagcaactcgtcaaagaagtccaacagcagctggatgagcttgtaaaacttcaactaccttcatacatggttccgcaatctattcaagttttggataaacttccaataaaccagaacggtaaggtagatcgaaaagcccttgcacaacgaacaaaaacgagtgtggtagttggccaagacgtccagcaacgagaactcagccctgcagaactcaaggtgcagaagatactggcgcgagtacttggaattgacgccagtcgtattggattggaagacagtttcttccagctaggtggagactcaattgcagctatgaagatagtggcagcagctcgagaagaggacatccaactcacggttgcgaacatcttccagcaccccaagctcatcaacctggccactgtcgctcagttctcacaagttgtagctgacgagaagccgactgaaccattctctttcctctcgccaaccgaaaaggagcatcttctccaggctatacctatgaatacctccaaggtagatagaaacgacattgtcgacatccttccaacgacatggatgcagaatctgttcatctcccggggtgtcaacattctacccctagctttcaactatttcttcctcgatttggggacacgtgttgacgtttctcgcctcagacgcagtatcccggctcttgtcaaacacttctctatccttcgcacaaagttcgtttatgtcgacggagtgttatggcaaactgttcttcgcaacccggaagttccctttatcaagttcgagcttgatatgtctcttgacgaagcagctgacactgtctgcttagaggacagtcggaccacgaagcccctggagttggctactgctttcttgttggtacgaagcttctcaggcgaacaccggttggtaatccgcattacgcatgctcagtacgacggtgtttgtttcccgtcattcgtaaagacgctttttgccatttactctggcaaacccatagagcctacgcacagctactcgacctatctggcctacactcggggtagaagatcagtctcatcacagtactggcgtaacctcctccaaggctcgcggatcacaaaagtcactccgctgctcggtcctagcattcggcgtggcaacgatccaattgagatccagacagaaagtatcatcggcatgccccacgtgccaactggttttactctagcctcaatcgtcagttcggcctgggcaagggtgctctcacaaatcactggagaagaagacgtcgtctatggatacatgatagccggccgcaacgcgaacattccaaacattacgaaaattgtcggtccctgcctgaacatcatccccgtccgagcacgagtccatccaacaacttcttcaaccgacctagtgcgcgcaatccaagaacaatacatcgcactcggcgaagccgattcaatgggctttgacgacatcgtgcgcacatccacagactggccagccgatgcgcattacgactcggtgttccagtaccagaacctgaatgaacacccggtatttgatttcgaaggcacagattctaggctgcattggtttcagaatcctgattcggtaccggctatcttgactgtggtggcctatccgcttgaggatggactcaggattgtggttaggggtaatgagcatatgattacgcctgagggtgcggagttgattaataaatcgctatgtgagatggttgggaaagtgtctacttcgctgcatgcggtgtaaaaagattgggaaaggacggggatgatgcaagggttaattaaaagccacttgggtggaacacttgtcatgactggagattggggtgagatagtctctagatagtagctactaggttttctgattgtccttcaggagaccggcttcgagggcggatttggcgtaccgaggatagatctctttactacacaaaattattatagataaagacattgtgtgcgatatggtac

SEQ ID NO: 20 - protein, 5101 aa, Cochliobolus sativus
MTYKQLDEHSTQLASYLAGLGVVAEEMIPLCFEKSIWTVVAMLAVLKAGGAFVPLDPSHPRSRHEEIFKQTKAKVVLTSAQYANLWPNSTQQILAVSNALINQLSVETKVCSKVEPWNAVYVMFTSGSTGVPKGVVLEHGAITTSCLAHGKAMRLGPNSRALQFAAYTFDICIAEIFTTLIFGGCVCIPSEDDRRNALPEVINNNNINWAQLTPTVARLLDPLTVPSLKVLVLGGERVDEADWKRWDHSVVQINVYGPTECSIWCTFHENTGLDFQSGMIGRSMASVSWVTNPDDHNQLVPFGEIGELLVEGPILARGYLNDTLKTEAAFVSNPPWLMQGSDDRTGRQGRLYKTGDLVYYNENGDLVYVGRKDSQVKVRGQRVELGEIEHHLHQCMPGVKQLAAEVILPTGDQGKAMVAAFLQLSEETHHTLISQISDSDSEVQVIFPTQVDEQLVQRLPRNMVPEVYFAVMEIPLTTSAKVDRQRLRKIGASFSTQQLAQLRTRGDSLKRQPNTEKGKTLQKLWSQILSIDSEFIGMDDSFFSLGGDSIAAMKLVGEARRSGIQISVAVVFRNPTLDQLTSAAVASAGGSTAAIPHVGSGGPVAQSFAQGRMWFLEELHPGLTWYLMPVVVRIRGLLQLSALESALNAIENRHETLRTTFETIGDASMQVVQPFHPRVMNVVDVDEQGLTDAVHRDQTTPFDLRTEAGWRVSIYRISKEDHVLSIVMHHIVSDGWSTDVLTRELGVFYSASIQGQDPLSCVQPLPIQYRDFSVWQRQQAQIDNDQSQLEYWSNQLNTSRPAELLCDKPRPTALSGQAGKQRLDIDGPLYSKLQQFCKTHGVTQFMVLFAAFRATHFRLTGQNDATIGTVNANRDRWELKDMIGFFVNLQCLRTTITDESFEELVQQVHEVTIASLANGDVPFESIVSKLKNTRDMSRHPIVQLIFAVHSQRKLGHLTLEGMETESLDNAPKSRFNIEFHFFQQEDSLKGDVVYSSDLYTPETISNMLSVFQIILEGCLQDPKAEIASLPLLREANYSKLKDLGLIHVERTDYPRESSIVDLFRQQVSICPSRIAVKDPLVEMTYAELEKESDVLSWWLAKQSFAPETLIGVLAGRSCQTIVAFLGILKAGLAYLPFDVKLPAKRMETILSSLPGQKVVLFGADLQPPNMKIGNVRFVRITEALDEQIGESSDSGNIVKPSATSLAYVIFTSGSTGQPKGAMVEHRGIVRLVRDNNFVQHLPASPVMAHMTNLAFDVSTWEIYASLLQGGTLICIDRMTVLDPEAVLRTFRREQVQTAFMTPSLFRTYLQQSPAMFANLEMLCVGGEALQSNDILSIKTLRTGTIINGYGPTENTTFSTIFVLSKDDQYANGVPIGRALSNSGAYVMDSKQQLLPLGVVGELVVTGDGLARGYTDPKRNIDRFVTVEIDGENMKAYRTGDYVRYRPTDGQLEYFGRMDGQVKIRGHRIELGEIEHVLRSHKSVSEAVAVVQQQNVDEAARLAAFVTVYEGDVIVDEEPNDNDESQHVNTWEDQFDSKVYMPISNVLPEAIGRDFIGWTSMYDGSAIDKAEMNEWLDETINTMLNGGKPGKVLEVGTGTGMILFNLGDGLESYIGLDPSQKAVDFVKDTARSIPTLADKVRVYKATAAELDRLPPIDANLVVINSVVQYFPSLDYLFKTVQHLLEIEGVSTLFFGDVRSYALHREFLATRALFMVGDSAEKDNVRRMIADMERVEREFLVDPGFFTALPERLPDLIEHVEILPKKVKATNELSCYRYAAVVHVKSRHGQKQEQVIRHVGHDEWIDFAKHKLDRPSLLKRLQSLSSSSTIAVSNIPYSKTIVSRCLINSLEDAVAETPDSSNWLSSVYQQAEHCPSLSAVDLHELAAEANCRVEISWNRQHSQRGGLDAIFHRCLPQKGENRVMFQFPTDHAERPLHSLSSTPLRQQVLQRTQKQLQEILEAQLPAYMVPQTITFLDAMPTNQNGKVDRTALTQKTEIQTVEGQEFQRELTRAELKVQQLMARVLRINANRIGLDDSFFQLGGDSIAAMRLVAMAREEDIQITVAKVFQYPKLIQLAAVAQEHVYVPSDNIVPFSLIDPEFDTTQIHQEVAASCKVDRGLVEDIYPCSPLQEGLMSLTVKRPGDYIMQTVLELRPDVDEVAFRSAWEKAVQSLQILRTRIVVHKTLGLLQAVVTDKMKWAEADDLTTYLSEDKLSSMQLGEPLARYALVRDSRREKRWFVWTIHHAIYDGWALTHILNAVQMAYDGAVPEKQLGFNNFIKYLGQLDQDALAAYWGATLSDCEANVFPPLQSGVQQPVADATAEYQCPPLPKRTSNTTISTLIRTAWAIVASGYTSSDDVVFGATVTGRNAPVAGIESLVGPVIATVPVRIRLQRDLTVLELLESVQKQATEMIPFEQTGLQRITKLVPEAQHACSFQTLLIVQPAEDAFQTDNVFGKWEFGSGLQDFTTYALMVQCKLAKEGVKITASFDARLVEQWQVENMLAQLSFVMQQLAQGDLSTRVRDITMLTPSDEQQLWKWNHKLPPAIERCVHDLYLEQVNSQPKADAICAWDGRMTYEELDETSSRLAHHLTSLGVKPESIVPLCFEKSIWMVVAMLAVLKAGGAFAPLDPSHPTSRHQEIFDQTKAKIALTSTQYANLWPELSQIVLSISTDFIDQLPTKLYDAQIAVQPGNTAYVIFTSGSTGVPKGVQLEHKAVSTSCLCQGPALGITKNTRALQFAAYTFDACILEIITTLVHGACVCIPSESQRRDNLIDTINAMEVSWALLTPAVARILDPQKILSLKTLVLGGEKVNASDCDIWSDRVQLINAYGPTECCVSCVANPDMKGLDPEPIGKSVASVGWVTNPDDHNRLAPLGAVGELLIEGPNLARGYLNDAKKTETAFISEPPWLLRGSEGHNGRRGRLYKTGDLVYYTIDGNLVYVGRKDNQVKVRGQRIELAEIEHHLYQCMPDIKEIAVEVILPTGGKPVVAAFLEANSELLNSKKSDGGSGVHVVFPAQADDELSQRLPRDMVPGVYFALVEFPIMTSGKIDRKRLREIGCSFSAQQLAQLQTQRDEGLKRQPETEQEKVLQQLWAQVLGIDATSIGLDDSFFRLGGDSIAAMKLVSEARNVDLKLSVQDVFQTQRLGQLAKQSLHSSTESVITKGNHRGPVTQSFAQGRLWFLEQLHPGLDWYLMHLAVRIRGPLQLQALQAALQTVERRHETLRTTFSTTNGESLQEVHPFRDGKDLNVLDINSNDDKVVLETLELEQKTPFNLRSEPGWRVTVYRINGDHHVLSIVMHHIVSDGWSVDVLKKELSTLYAAAVRGEDLNSCLPPLPIQYRDFSVWQRLPGQVQEHQRQLDYWINQLDSSRPAEFLYDKPRPATLSGKAGTQKLTISHKLYERLQNFARERGVTPFVVLLTVFRAAHYRLTNQDDATIGVPNANRSRWEVGDLIGFFVNIQCLRIKIQDETFEELVQQVYTTVVDSLANQDVPFESIVAALQGDRDISRNPLAQVAFAVHSQQDIGKFSFDGVETEVMEGLATSRFDLEFHFFQEKNSLQGYIYFSEELFAPESIRSLASIFTSILDNCLAKPETQIAVAPLMTDQAHIQLDQMRLLGMNEMAYSRDSSIVDVFRQQVAMQPSRIAVKDALAELTYAELDAQSEKLAKYLATKAFALETAVGVLAHRGCQAIVAFFGILKAGLAYLPFDSKAPEKRMESILSTIEGKKLVLIGPNIQLPGTELKDVEFAHIVDILNADDNAEFTRSELDPALKPSPSSLAYILFTSGSTGQPKGVMVEHRGIVRLAQHDQMEHFRSSEATAHMANLAFDGSSWEIYTCLLNGGTLACIDATTVLDQDALLRAFREFKIRIAFITPALLKYILAESPDTIGHLDTLLVAGDRADIDDFFAARNLVTNKVVNAYGPTENSVMSTLYILSDDEDCVNGVPIGRSISNSGAYVMDPEQNLVPLGVVGELVVTGDGVARGYTDPNRNVDRFVTVTVGNQTVRAYRTGDYVRQRPIDGEMEFFGRIDGQVKIRGNRVELGEIESVLRGHNFVRDAVVVAEKQQEKDQRLFGYVTLKEGSEMPSGKNSDSNQIQHVSAWEDRFNTEIYAPISSIESGTIGQDFIGWTSMYDGSDIDKAEMKEWLNETINAIHTKAGGRLGNVLEVGSGSGMILFNLGNTLERYTGFEPSRKAVDFIMGTARSIPSLANKVEMYKATAADISQVNPPLRADTVILNSVVQYFPSQEYLFNVVRDLLQVTGVKTLFFGDIRSHALRREFFAARALFMAGERASKEELRRMMEDMEQIERELLVDPGFFTSLARRLPDLVQHVEIEPKQMKATNELSSYRYTAVVYSRSWSPPSGALRTIPDNEWIDFKEQNLDHGSLRQRIKDVSSTRPIAISNIPCSKTIFGNLLLSFLEDEKARKPVHMDWSVLIDQEFKRMPSLSAVDLDEMAKEVGCRVQIGWNRQYSQQGGLDAIFYPRQVNGDINKSELIFSFPTDHTDRPQQTLSNKPMRQQLVKEVQQQLDELVKLQLPSYMVPQSIQVLDKLPINQNGKVDRKALAQRTKTSVVVGQDVQQRELSPAELKVQKILARVLGIDASRIGLEDSFFQLGGDSIAAMKIVAAAREEDIQLTVANIFQHPKLINLATVAQFSQVVADEKPTEPFSFLSPTEKEHLLQAIPMNTSKVDRNDIVDILPTTWMQNLFISRGVNILPLAFNYFFLDLGTRVDVSRLRRSIPALVKHFSILRTKFVYVDGVLWQTVLRNPEVPFIKFELDMSLDEAADTVCLEDSRTTKPLELATAFLLVRSFSGEHRLVIRITHAQYDGVCFPSFVKTLFAIYSGKPIEPTHSYSTYLAYTRGRRSVSSQYWRNLLQGSRITKVTPLLGPSIRRGNDPIEIQTESIIGMPHVPTGFTLASIVSSAWARVLSQITGEEDVVYGYMIAGRNANIPNITKIVGPCLNIIPVRARVHPTTSSTDLVRAIQEQYIALGEADSMGFDDIVRTSTDWPADAHYDSVFQYQNLNEHPVFDFEGTDSRLHWFQNPDSVPAILTVVAYPLEDGLRIVVRGNEHMITPEGAELINKSLCEMVGKVSTSLHAV

SEQ ID NO: 21 - DNA, 15477 bp, Bipolaris oryzae
  CDS (1)..(15477)
atgggtgacataggaaaaccattacaggtcgacatggataagagtgatgtcgacaggatatgggagaggaatttcgggatcataccagcagtcgagcattgcgttcacgacttgtacgtagagcaagcaaaagttcgacctaacgcgcctgctatctgctcatgggacggcgagatgacctacaaacaattggacgagcattcaacacaactagcgagctacctagctggtctgggtgttgtagccgaggaaatgataccattatgctttgagaagtcaatatggacagtggtagccatgcttgctgtcataaaagctggtggtgcgtttgttccgctggatccatctcacccaaggtctcgccacgaagagatattcaaacagaccaaagctaaggtggtacttacttccgtacaatacgcaaatctttggccaaattcaacgcaacagattcttgcagtcagcaacgccttgatcaaccagctatcagtcgagactaaagtttgttccaaagtcaagccatggaacgctgtatatgcgatgttcacatctggtagtactggagttccaaagggtgttgtcttggagcacggagcaatcacgacaagctgtctagctcacgggaaagcgatgagacttggacccaactctcgagccctccagtttgcagcttatactttcgacatttgcatcgctgaaatattcaccacactgatatttggcggatgcgtttgcattccctccgaagacgaccgacgtaacgccttgtcagaagtcatcaacagcagcaatgtcaactgggcgcaactcacaccaacagtcgcgcgtctacttgatcccctaacagttccgtccctagaggtgctcgtcctgggaggagagcgagtggacgacgccgattggaaaagatggaatgacaatgtcgtacagataaacgtatatggcccaacagaatgtagcatttggtgcacttcacatcaaaacactggtcaggggtttcagtcagggatgatcggtagatcaatggcttcagtcagctgggtgactgacccagacgaccacaaccagctggtgcccttcggcgaggttggagaacttctagtagaaggacccattctagcacgtggctatctcaacgacacattgaagactgaggccgccttcatcagcaaccccccctggctgatgaagggtagcgacgatcataccggacggcagggaagactgtacaaaacgggagatctagtctactataatgtagatggcgacttggtctatgtaggtcgaaaggacagccaagtcaaggtgcgcggccaacgagttgagttgggtgagattgagcaccacctccaccaatgcatgccaggtgtcaaacagttggctgctgaagtcattttaccaacaggagaccagggcaaagcaatggtagcagcatttctgcagctgagcgaagagacacatcacacactcaccagccagatttctgacagcgactctgaagtgcaagtcatctttccaactcaagtgaacgagcagctagctcagagattaccaagagatatggtgcccgaagtatactttgtagtgacggaatttccattaacaacgtccgccaaagtagacaggcagcggttacgtaagattggagcatccttttccgcacagcaattggcccaattgcggactcgaggcgatggtccaaagcgacaaccagatacagaaaaaggaaagactttgcagcaactatggtcgcaggtacttagcattgattcacagtccatcggtatggatgacagtttcttcagtctgggtggcgactcgatcgcggctatgaagctggtgggcgaagcacgtaggtcagggatacagatcagcgttgcagtcgtcttccgcaatcccacattggaccagttgacctctgcagcagttgcttcaactgacagctcttttgctatcattccgcacgttggaagtgatggacctgttgcgcaatcatttgcacagggtcgaatgtggttcttggaagaattacactctggtctgacatggtatctcatgccagttgtagtgcgtattcgtggcccgctgcagctctcggcgctagaatctgcgctaaatgcgatcgagagccgtcatgaaactctccggacaactttcgaaaccattggagatgcaagcatgcaggtggttcatccgttccatcctagggtgatgagcgtcgtcgacatagacgaacaggacctcacagatgctgtgcaccgagaccagacaaccccctttgacttacgcactgaggccgggtggagggtttcgatctatcgcatcagcaaagaagactatgtgctgtccattgttatgcaccatatcgtctcggatggctggtccactgatatacttacgcgagagttgggcgtattctactcagcctcgatacaagatcaggatcccatttcttgtgtgcaacctctgcctatccaatatcgggatttttcagtgtggcagagacaacaagcacaggttgacaatgaccagagtcagctcgaatattggtccaatcagctgaaaaccagcaggccagcagagctgctgtgcgataaaccccggcctgctgctctatctggacaagctggaaagcaaaagctcgatatcgatggaccactttacagtaaactacaacaattctgcaaaactcacggagtaacacagttcatggtcctgtttgcagcctttagagctacacacttccgtctaacaggtcagaacgacgcaacgataggcactgtgaatgccaaccgagatcgatgggagctaaaagatatgatcggctttttcgttaacttgcaatgccttcggactacgatcaccgacgagtcattcgaagaactagttcagcaagttcgtgaagcaacaattgcttcccttgctaatggagacgttccattcgaaagcatcgtctctaagctaaagaacactagagacatgtctcgtcatccgattgtgcagctcatttttgccgtacactcccagcgcaagttaggacatctcacactagagggcatggaaacagagagtctcgacaatgcaccgaaatcgagattcgatcttgagttccacttctttcaacaagaagacagcctaaggggagatgttgtctattcaaccgacctttatacacctgagacgattagcaacatgctatcagttttccaaatcgttcttgaggggtgccttgaagacccgaaagctgcaatcgcctctctaccgttgttgcgcgaatccaactactccaagctcaaagaattagatctcattcgtgttcagaggactgattacccacgtgagtcgagcatagtcgatctcttccgtcagcaagtatcaacctgttcgtcaaggattgctgttaaagacccgctggtagagatgacttatgccgagcttgacaaggaatctgacattctctcctggtggctagctaaacagtcgctcgctccagagacattggtaggcgtattagcaggtcgaagctgccagactattgttgcatttttgggcatcttgaaggccggcttggcgtacctaccgtttgataccaaactaccagcgaagcggatggaaaatatcctttcctcgttaccaggccagaaaattgtgcttgttggggctgacgtacagtcctcgagcatgaagatcggtagcgtccagtttgtacgcatcacagacgccctcaacgagcagattgacgaatcatccgattccggaaacatcatcaagccttcagcaactagcttggcctatgtcatgttcacatcaggatcaacaggccagccgaagggtgctatggttgaacatcgtggtattgtgcgcttagtaaaagacaacaattttgtccagcacctaccagcctcaccagtcatggcgcatatgacgaatcttgcattcgatgtctctacgtgggagatatacgcttctctcctacaaggtggaacgctagtctgcatcgacagaatgacagtgttggatccagaggctgtgttgcgaacattccgtcgagaacaggtcaaaacagcatttatgacaccatcccttttccgaacctacgtccagcaatcacctgcgatgtttgctaacctcgagatgctttgtctcggtggcgaagcacttcaatcaaatgatatcctttccataaagacacttcagacaggcaagatcatcaatggctatgggccgactgaaaatacaactttcagcacaattttcgttctatcaaaagacgaccagtacgcaaatggcgtgcccattggccgtgcacttagcaattctggcgcctatgtcatggattcgaaacagcagcttctcccccttggcgtcgttggagagcttgttgtcacgggcgatggcgtggcgcgtggatacactgatcctaagcgcaacattgaccgttttgttacagtcgagattgacggcgagagtatgaaagcttaccgtacgggtgattacgtgcgttatcgttccgacggccagctggaatatttcggacgaatggacggacaggtcaaaattcgaggacatcgcattgagttaggcgagattgagcacgttcttcgcagccataagtccgtaagtgaggccgtggctgtagtgcagcagcaaaatgcagacgaggctgctcgattagctgcgttcgtcacagtctacgagggtaacgtagtagttgaccaagagcctaacgacaacgacgagtcacagcatgtggatacatgggaagaccagtttgattcgaaggtctatatgcccatttccaatgtccttcctgaagctattggacgagacttcattgggtggacttccatgtacgatggcagcgccatagataaggcggagatgaacgaatggcttgacgagacaatcgatacaatgctcaacggcggtaaacctggcaaggtgcttgaggttggtacaggaactggtatgattctgttcaacttaggcgacggtctggaaagttacattgggctggatccatcgcaaaaagccgttgattttgtcaaagacactgccaggtccgtacctacgctagcagacaaggtcagagtctacaaggccacagcggcagaacttgatcgcctaccgcctattgatgcaaatcttgttgttatcaattcagtcgttcagtatttcccaagtctggattaccttttcaagactgtgcagcagctggtcgagatagagggcgtctctactctcttctttggcgatgtccgatcttatgcgctacaccgggagtttctcgcaacgcgtgcgctgtttatggttggagacagtgcagaaaagtctgaggtccgtcgcatgattgccgacatggagagagttgaaagagagtttctagtggacccaggtttcttcactgctctaccagagcgcttaccagattttatcgagcacgtcgaaatcttaccaaagaagttaaaggccacgaatgagctgagttgctaccggtacgccgccgtcgttcatgttaagtcacgaaatgggcaaaagcaagaaccggtgattcgatgcgtgggacacgacgagtggatcgattttgctgaacacaggctggaccgcccgtctttcttgaagcagctccagagcctttccagctcgcccaccatagctgtgagcaacattccttacagtaagacgattgtgagccggtgtcttatcgactcgttggaagatgacgtagcagatacgtctgattcgtcgaactggctctcttcagtgtaccagcaggcagaacactgcccctctttgtctgccgctgatctacatgagttagcggccgaggccaattgccgtgttgagattagttggagcagacagcactcccagcgcggtggtctcgacgcgatattccatcgctgccagccacaaaagggagagaacagagtgatgtttcgattccccaccgatcatgcagagcggcctctacacagcctgagcagcacgccgctacggcaacaggtcttgcagagaacccaaaaacaacttcaggagatacttgaagcccagctacccgcttatatggtcccccagacaattatgttcctagacacgatgccaaccaaccagaacggcaaggtagaccgtaccgttcttacacagcaaacggaaattcagacagtagaaggccaggaattccaacgagaactcactagggcagagctcaaagttcagcaactgatggctcgcgtacttcgcatcaacgcgaaccgcattggcctagatgatagctttttccagctaggcggcgattcgattgcagctatgagattggttgctatggctcgcgaagaagatatccaaattacggtagcaaaagtcttccagtaccctaaacttatccaactagccgctgtagcccaggagcatgtctacgttcctagcgacaacatcgtcccattttctctaatcgaccccgaagttgatgcaacacagacacaccaagaagtggcggctagttgcaaagtcgacaggggtcttattgaggatatctacccatgctcgccgctccaggaaggcttgatgtcgctaactgtgaagcggccaggggattacatcatgcagacagtgctggaactgcgaccagatgtggatgaagcagcctttcaaagtgcatgggagaaaacggttcagtcattacaaatattgcgaacacgtatcgtagtacacaagacgcttggtttgttgcaggctgttgtgacggacaaaatgaagtgggcagaagcagacgatctgactgcttacctagctgaagacaaactgtcatctatgcagcttggtgagccacttgcacgctatgctctggttcgagactctcgtagagaaaagcggtggttcgtatggacaattcaccatgctatatacgatggttgggcgctaacccacattttgaacgctgtacaaacggcatataacggcgcagagccagagaagcagtttggtttcaacaacttcatcaagtatcttggccagctagatcaagacgctctcgcagcatattggggggctacgcttagcgactgcgaggcgaatgttttcccaccactacgacccggggtgcaacagccagtcgcggatgcaacagcagaatatcaatgccctcctctccctaaaagaacctcaaacactacaatctcgacactcattcgcacagcttgggcgatcgttgccagcggctatacgagctcagacgacgttgtgtttggagcgacagtcacgggtcggaatgcaccagtggctggcatcgagtccctagttggacccgtgattgcaacagtgccagtacgaatacgtttacagagggatcggactgttctagaacttctcgaaacggtacaaaaacaggcaacagaaatgattccgttcgagcaaaccggcttgcaacggatcacgaagctagtaccagaagcccaaaatgcctgtagctttcagacacttctgattgtccagcctgcagaagacgcattccaaacagacaacgtgtttggaaagtgggaatttggctcaggactacaagacttcacaacgtatgctctgatggtacaatgcaagctggctaaagagggggtcaaaatcacggccagctttgatgcgcggttggttcaacagtggcaagttgagaagatgttggctcaactaagcttcgtcatgcagcagttggcccgaggagacctaagcacaagagtcagggacattgaaatactcacgccaagtgacgaacaacagctgtggaattggaaccacaagctaccaccgactatcgatcgttgtgtccatgatttatacctggaacaagtaaagtctcaacccaaagcagacgcgatatgtgcatgggatggtagaatgacctatgaagagctggacgaaacatcatcgcgcctcgcacaccatttgaccagccttggggtcaaaccagagagcatagtgcctctttgttttgaaaaatcgatttgggtggttgtagctatgctagctgtgctcaaagcagggggtgcctttgcgcccctggatccgaatcatccaacatctcgtcaccaagagatcttcgaccaaaccaaagccaatatagtcctcacctcgacacagtacgccaacatctggccagaacgttctcaaattgtcgtgtcaatcagcagagacttcattgatcagttgccgaccaaaccttgcgacgtccagatagcgatacagccaggcaatacagcgtatgtcatctttacatcaggaagtaccggagtgcccaagggtgttcaactagagcataaggccgtttccacaagttgcatatgccaagggcctgctttaggaattacaaagaatactcgagctcttcaatttgctgcctatacatttgacgcctgtattctagagattatcacgactctagtacatggcgcttgtgtatgtattccgtctgagagccagcgacgcgacaatctcatcgacacaatcaatgcgatggatgtcaactgggcactgttgactccagctgtcgcgagaatcttggacccacagaagattgtaccgttgaagacgttggttctcggtggtgagaaagtcaacgcttcggactgcgacatctggagtgaccgcgtacagctaatcaacgcttacggacctacagaatgctgcgtctcttgtgtcgcaaatcccgatatgaaggggcttgatccggaacctatcggaaagtcagttgcatcggtcggatgggtagctaatccagacgatcacaacaggctagctccgttgggcgcagtgggcgaactgttggtcgaaggaccaaacttagcacgcggctatctgaacgatgcaaagaaaacagaaactgcctttatcaatgaacctccctggctacttcgaggcagtgaaggctatagtgggcgacgaggcagactgtacaagactggtgacctggtctattacaccgcagatggtaatttggtctacgtcggccgcaaagacaaccaggtcaaagtgcgtggccaacgcattgagcttgctgagattgagcatcatctctatcaatgcatgccagacatcaaagagattgcagtcgaagtgatcttaccaacaggaggaaagccaatagtagcagcgttcctggaagcaaactccgagctacttaacagcaggaagtctgatggggactctggagtccatgttgtgtttccagcccaagcagacgacgagctgtctcaacggttaccccgggatatggtgcctggggtttactttgcgctagcagagttcccaataatgacgtctggtaagatcgaccgaaagcgactacgcgagattggacgctcgttctcagcccagcagctagcccagctgcaaacacagagagacaagggcctaaaacgacagccagagacagagcaagagaaggtgttacaacagctatgggcgcaggtgctaggcatcgacgctacttccattggactcgatgatagcttcttccggttaggtggcgactctatcgcggctatgaagcttgtgagcgaggcgcgcagcgttgacctgaagctttctgttcaggacgttttccaagcgcagcgacttggtcagctggtcaaacaatcacttcactcttccactgagagtgtaatcacaaaaggcaatcatcgggggcctgtcacccaatcctttgcgcagggccgactttggttcttagaacaactgcatccggggctagactggtacctcatgcaccttgccgtacgcatcagaggcccacttcaactccaagctctccaagctgcattgcagacagtagagcgccgccacgaaacgctaagaacaacattttccaccaacaatggcgaaagtctacaggaggttcatcctttccgtgatggaaaagacctaaatgtcattgacatcaactcaaacgatgacaaagttctgctagaagctctggaattggaacaaaagacaccatttaatctacgaagcgagcctggatggagagtatctgtctataatatcaacggagagaatcatgttctgtccatcgtcatgcatcacatcgtttcagacggctggtcagttgatgttttgaagaaagaactgagcacactgtatgctgctgcagttcgcggcgaagacctgaattcctccctaccgcctttacccatccaatatcgcgacttctctgtctggcaaaggctgccgggtcaagttcaagaacatcagcggcagcttgattactggatcaaccagttggactcaagccggccagcggaatttctgtatgataagccccggccagctactctatctggcaaagcaggcacacagaaactcactatcagccacaaactttatgaaaggctacaaagttttgcgagagaacatgggatgactccatttgttgtcctcctcactgttttcagagccgcgcactaccgcctgactaaccaggatgacgcgaccattggagtacccaatgcgaatcgaagccgttgggaggttggagatctgattggattcttcgtcaatattcaatgtctccgaatcaagattcaggatgaaacctttgaagagctgttgcaacaggtctacacgacagtagtagactcacttgctaaccaggacgtaccctttgagagtatcgttgctgcattacaaggagaccgggacatttcccgcaaccctcttgcccaggttgcattcgctgttcactcacagcaagacatagggaagctatcgttcgatggtgtcgaaacagaagtcatagagggcctagctacctcacgttttgacctcgaattccatttcttccaggaacaggatagtctacaaggctacatatacttctcagaggagctcttttctcctgagagtatacgttcgctagcatccgtctttacaagcatccttgacaactgtctcgccaagccagaaacgcagattgcggtagtgccactcatgaccgaccaagcacacattcagctcgatcagatgggactcctcggcatgaatgagacagcctattctcgagattcaagcattgtcgacgtattccgccagcaagtcgctatgcaaccgtccagaattgctgttaaagatgcattggcagagctgacatacaccgagctagacgcacagtcagagaagcttgcaaaatacctggcgacgaaatcgtttcctcctgaaacggcagttggtgttctggcgcgtcgaggctgtcaagcaattgttgcctttttcggtattctcaaagccggattggcctaccttccattcgattcaaaagcaccagaaaagcgaatggaagcgatcctatcaaccattgaaggaaaaaagctagtcttagtcggtccaaatatccggttgcccggtgcaggactcgaggatgttgaatttgctcacattgtcgacatcttgaacgcagatgataatgctgaattcacaagaaacgagcttgatcctgctctgaagcccagtccttctagtctcgcttacattctatttacgtctggctctactggtcaacctaaaggagtcatggtcgaacatcgtggcatagttcgcctggcacaacacgaccagatggagcacttcagatcatctggagccaccgctcatatggcaaatcttgcttttgatggatcttcctgggagatctatacttgtattctgaatggaggaactctggcttgcattgatgcgacaactgtactggaccaggatgccctattacgtgccttcagggaattcaagatccggatcgctttcatcacgcctgctttgctgaaatatatcctagccgaatctccaaacacaatcggtaacttggataccctccttgtcgcaggagacagagccgacatagatgacttctttaccgcacggaaccttgtgacaaacaaggtcgtcaacgcatatggtcctactgagaactcggtcatgagcacactatacatgctctctgatcacgaggattgcgtcaacggtgtacctattggacgatctatcagtaactctggggcatacgtgatggatccagagcagaaccttgtaccacttggtgttgttggagagcttgttgttactggagacggtgttgccagaggatataccgatccaaatcgcaatgttgaccgtttcgtgactgttacagtcggaaaccaaacagtgcgagcctaccgtactggagactatgttcgtcagcgacccacagatggggaaatggagttcttcggtcgcatcgatgggcaagtcaagatccggggcaaccgtgttgaacttggagagatcgagagcgtccttcgtgggcacaactttgtgcgtgacgcagtggtggtagcagaaaaacaacaagagaaagaccaacgacttttcggttacgttactctgaaagaaggatccgaaatgcctgccgggaagaacagcgatagcaaccaaatacagcacgtgagtgcgtgggaagaccgcttcaacacagagatatacgccccgatcagcagtattgagtctggaacaatcggccaggattttatcggatggacctcaatgtacgatggctctgatattgacaatacagagatgaaggagtggctgaacgaaactatcaatgcaatccacaccaaagccggtggacgattaggaaacgtactggaagttggatcgggatccggcatgattctcttcaacctcggaaataccctagaacattacaccggatttgagccctcaagaaaggcagtcgacttcattatggggacagccaggtctatcccctcactcgccaataaagtggagatgtataaggctacggccgctgacatcagtcaagtggatccaccactccgggctgacacggtgattctaaactcagttgtccagtattttcccagccaggagtatctcttcaacgtaattcgagacctgctccaagttacaggggtcaagacattgttctttggcgacatccgttctcatgctctgcgccgggaattctttgcagccagagccctctttatggcgggtgaaagggctagcaaagaggatctacgacgtatggtggaagacatggaacaaatcgagcgggagcttctggttgaccctggcttttttacttcattagcaagtcgtcttcccgatttagtccagcatgtggagattcagcccaagcaaatgaaagccacaaacgagttgagctcctaccgctacacggctgtggtatactctcgatcctggagtccgccatctggagcgcttcgaactatccccggtcatgaatgggtcgacttcaaggaccagaaactggatcgtgtatctctccaacagcgtataaaggatgtctcaagcacacatcctatggccataagcaatattccctgcagcaaaactatctttggaaatcgccttctaagctccttggaagatgaaaaggccagaaaaccggtccacatggactggtccgctctgattgacaaagaagtcaagcagacgcccagcttctctgccgttgatctggatgagatggccaaggaagcagggtgccaggtgcaaatcagctggaacaggcaatattcacagcagggtggcctggacgctatattctaccctcgtccagtcaacggtgatgctagcaagtctgaactgatgttttcattcccaacagatcatacagaccggccacagcaaaccttgagcaacaagccaatgcggcagcagcttgttaaggaagtccaacagcagctagacgagcttgtgaaacttcaactgccttcgtacatggctccgcaatccattcaagttctggataaacttccaatcaaccagaacggcaaggtagatcgaaaagcccttgcacaaagaacaaaaacgaatgtggtagttggccaagacgcccaacaacgagaacttacccctgcagaactcaaagtgcagaagatactggcgcgagtactcggaattgacgctagtcgtgttgggctggaagacagcttcttccagctaggtggagactcaattgcagctatgaagatagtagcagcagctcgagaagaggatatccaactcacggttgcaaacatcttccagcaccccaagctggtcaacatggccactgtagctcagttctcacaagtagtagctgaagagaagccaactcaaccattctctttcctctcgccaaccgaaaaggagcatcttctccaggctatacctgcaaatacctccaaggtggacagaaacgacattgtcgacgtccttccaacgacatggatgcagaatctgttcatctcccgaggtgtcaacgttctacccctcgctttcaactatttcttcctcgatttgggaacacgtgttgacgtttctcgcctcagacgcagtatccctgctcttgtcaagcacttctccatacttcgaaccaagttcgtctatgtcgatggagtattgtggcaaactgttcttcgcaacccggaagttccctttatcaagttcgagcttgatatgcctctggatgaagcagctgatactgtctgtttagaggatagtcggaccaccgagcctctagagctggctactgctttcttgttggtacgaagctcctcaggcgaataccgtttggtaatccgcatcacgcatgctcagtacgacggcgtttgtttcccgtcattcataaagacactttttgccatttactctggaaaacctgtagagcctacacacagctactcgaactatctggcctacattcggggtagaagatcggtctcatcacagtactggcgtaacctcctccaaggctcgcggataacaaaaatcaccacgttgctcggtcctagcatccgacatggcaaccacccagttgagattcaaacacaaagtatcattggtatgccccacgtcccaactggttttactctcgcctcaattgtcagttcggcctgggcaagggtcctctcacaaatcaccggagaagaagacgtcgtctatggatacatgatagccgggcgcaacgcgaacatcccaaacattacgaaaattgtcggtccctgcctgaacatcatccccgttcgagcacaggtccatccaacaacttcttcaaccgacctagtgcgcgcaatccaagaacaatacattgcactcggcgaagccgattcaatgggcttcgacgacattgtacgcacatccacagactggccagccgatgcgcattacgactcggtgtttcagtaccagaacttgaatgaacatccggtgtttgattttgaaggcacggattccaggctgcattggtttcagaatcctgattcggtaccggctatcttgactgtggtggcctacccgcttgaggatggactcagaattgtggttaggggtaatgagcatatgattacgcctgatggcgcggatttgattaacaagtcgctctgtgagatgattgggaaagtgtcttcctcactgcaggaggcatga

SEQ ID NO: 22 - protein, 5158 aa, Bipolaris oryzae
MGDIGKPLQVDMDKSDVDRIWERNFGIIPAVEHCVHDLYVEQAKVRPNAPAICSWDGEMTYKQLDEHSTQLASYLAGLGVVAEEMIPLCFEKSIWTVVAMLAVIKAGGAFVPLDPSHPRSRHEEIFKQTKAKVVLTSVQYANLWPNSTQQILAVSNALINQLSVETKVCSKVKPWNAVYAMFTSGSTGVPKGVVLEHGAITTSCLAHGKAMRLGPNSRALQFAAYTFDICIAEIFTTLIFGGCVCIPSEDDRRNALSEVINSSNVNWAQLTPTVARLLDPLTVPSLEVLVLGGERVDDADWKRWNDNVVQINVYGPTECSIWCTSHQNTGQGFQSGMIGRSMASVSWVTDPDDHNQLVPFGEVGELLVEGPILARGYLNDTLKTEAAFISNPPWLMKGSDDHTGRQGRLYKTGDLVYYNVDGDLVYVGRKDSQVKVRGQRVELGEIEHHLHQCMPGVKQLAAEVILPTGDQGKAMVAAFLQLSEETHHTLTSQISDSDSEVQVIFPTQVNEQLAQRLPRDMVPEVYFVVTEFPLTTSAKVDRQRLRKIGASFSAQQLAQLRTRGDGPKRQPDTEKGKTLQQLWSQVLSIDSQSIGMDDSFFSLGGDSIAAMKLVGEARRSGIQISVAVVFRNPTLDQLTSAAVASTDSSFAIIPHVGSDGPVAQSFAQGRMWFLEELHSGLTWYLMPVVVRIRGPLQLSALESALNAIESRHETLRTTFETIGDASMQVVHPFHPRVMSVVDIDEQDLTDAVHRDQTTPFDLRTEAGWRVSIYRISKEDYVLSIVMHHIVSDGWSTDILTRELGVFYSASIQDQDPISCVQPLPIQYRDFSVWQRQQAQVDNDQSQLEYWSNQLKTSRPAELLCDKPRPAALSGQAGKQKLDIDGPLYSKLQQFCKTHGVTQFMVLFAAFRATHFRLTGQNDATIGTVNANRDRWELKDMIGFFVNLQCLRTTITDESFEELVQQVREATIASLANGDVPFESIVSKLKNTRDMSRHPIVQLIFAVHSQRKLGHLTLEGMETESLDNAPKSRFDLEFHFFQQEDSLRGDVVYSTDLYTPETISNMLSVFQIVLEGCLEDPKAAIASLPLLRESNYSKLKELDLIRVQRTDYPRESSIVDLFRQQVSTCSSRIAVKDPLVEMTYAELDKESDILSWWLAKQSLAPETLVGVLAGRSCQTIVAFLGILKAGLAYLPFDTKLPAKRMENILSSLPGQKIVLVGADVQSSSMKIGSVQFVRITDALNEQIDESSDSGNIIKPSATSLAYVMFTSGSTGQPKGAMVEHRGIVRLVKDNNFVQHLPASPVMAHMTNLAFDVSTWEIYASLLQGGTLVCIDRMTVLDPEAVLRTFRREQVKTAFMTPSLFRTYVQQSPAMFANLEMLCLGGEALQSNDILSIKTLQTGKIINGYGPTENTTFSTIFVLSKDDQYANGVPIGRALSNSGAYVMDSKQQLLPLGVVGELVVTGDGVARGYTDPKRNIDRFVTVEIDGESMKAYRTGDYVRYRSDGQLEYFGRMDGQVKIRGHRIELGEIEHVLRSHKSVSEAVAVVQQQNADEAARLAAFVTVYEGNVVVDQEPNDNDESQHVDTWEDQFDSKVYMPISNVLPEAIGRDFIGWTSMYDGSAIDKAEMNEWLDETIDTMLNGGKPGKVLEVGTGTGMILFNLGDGLESYIGLDPSQKAVDFVKDTARSVPTLADKVRVYKATAAELDRLPPIDANLVVINSVVQYFPSLDYLFKTVQQLVEIEGVSTLFFGDVRSYALHREFLATRALFMVGDSAEKSEVRRMIADMERVEREFLVDPGFFTALPERLPDFIEHVEILPKKLKATNELSCYRYAAVVHVKSRNGQKQEPVIRCVGHDEWIDFAEHRLDRPSFLKQLQSLSSSPTIAVSNIPYSKTIVSRCLIDSLEDDVADTSDSSNWLSSVYQQAEHCPSLSAADLHELAAEANCRVEISWSRQHSQRGGLDAIFHRCQPQKGENRVMFRFPTDHAERPLHSLSSTPLRQQVLQRTQKQLQEILEAQLPAYMVPQTIMFLDTMPTNQNGKVDRTVLTQQTEIQTVEGQEFQRELTRAELKVQQLMARVLRINANRIGLDDSFFQLGGDSIAAMRLVAMAREEDIQITVAKVFQYPKLIQLAAVAQEHVYVPSDNIVPFSLIDPEVDATQTHQEVAASCKVDRGLIEDIYPCSPLQEGLMSLTVKRPGDYIMQTVLELRPDVDEAAFQSAWEKTVQSLQILRTRIVVHKTLGLLQAVVTDKMKWAEADDLTAYLAEDKLSSMQLGEPLARYALVRDSRREKRWFVWTIHHAIYDGWALTHILNAVQTAYNGAEPEKQFGFNNFIKYLGQLDQDALAAYWGATLSDCEANVFPPLRPGVQQPVADATAEYQCPPLPKRTSNTTISTLIRTAWAIVASGYTSSDDVVFGATVTGRNAPVAGIESLVGPVIATVPVRIRLQRDRTVLELLETVQKQATEMIPFEQTGLQRITKLVPEAQNACSFQTLLIVQPAEDAFQTDNVFGKWEFGSGLQDFTTYALMVQCKLAKEGVKITASFDARLVQQWQVEKMLAQLSFVMQQLARGDLSTRVRDIEILTPSDEQQLWNWNHKLPPTIDRCVHDLYLEQVKSQPKADAICAWDGRMTYEELDETSSRLAHHLTSLGVKPESIVPLCFEKSIWVVVAMLAVLKAGGAFAPLDPNHPTSRHQEIFDQTKANIVLTSTQYANIWPERSQIVVSISRDFIDQLPTKPCDVQIAIQPGNTAYVIFTSGSTGVPKGVQLEHKAVSTSCICQGPALGITKNTRALQFAAYTFDACILEIITTLVHGACVCIPSESQRRDNLIDTINAMDVNWALLTPAVARILDPQKIVPLKTLVLGGEKVNASDCDIWSDRVQLINAYGPTECCVSCVANPDMKGLDPEPIGKSVASVGWVANPDDHNRLAPLGAVGELLVEGPNLARGYLNDAKKTETAFINEPPWLLRGSEGYSGRRGRLYKTGDLVYYTADGNLVYVGRKDNQVKVRGQRIELAEIEHHLYQCMPDIKEIAVEVILPTGGKPIVAAFLEANSELLNSRKSDGDSGVHVVFPAQADDELSQRLPRDMVPGVYFALAEFPIMTSGKIDRKRLREIGRSFSAQQLAQLQTQRDKGLKRQPETEQEKVLQQLWAQVLGIDATSIGLDDSFFRLGGDSIAAMKLVSEARSVDLKLSVQDVFQAQRLGQLVKQSLHSSTESVITKGNHRGPVTQSFAQGRLWFLEQLHPGLDWYLMHLAVRIRGPLQLQALQAALQTVERRHETLRTTFSTNNGESLQEVHPFRDGKDLNVIDINSNDDKVLLEALELEQKTPFNLRSEPGWRVSVYNINGENHVLSIVMHHIVSDGWSVDVLKKELSTLYAAAVRGEDLNSSLPPLPIQYRDFSVWQRLPGQVQEHQRQLDYWINQLDSSRPAEFLYDKPRPATLSGKAGTQKLTISHKLYERLQSFAREHGMTPFVVLLTVFRAAHYRLTNQDDATIGVPNANRSRWEVGDLIGFFVNIQCLRIKIQDETFEELLQQVYTTVVDSLANQDVPFESIVAALQGDRDISRNPLAQVAFAVHSQQDIGKLSFDGVETEVIEGLATSRFDLEFHFFQEQDSLQGYIYFSEELFSPESIRSLASVFTSILDNCLAKPETQIAVVPLMTDQAHIQLDQMGLLGMNETAYSRDSSIVDVFRQQVAMQPSRIAVKDALAELTYTELDAQSEKLAKYLATKSFPPETAVGVLARRGCQAIVAFFGILKAGLAYLPFDSKAPEKRMEAILSTIEGKKLVLVGPNIRLPGAGLEDVEFAHIVDILNADDNAEFTRNELDPALKPSPSSLAYILFTSGSTGQPKGVMVEHRGIVRLAQHDQMEHFRSSGATAHMANLAFDGSSWEIYTCILNGGTLACIDATTVLDQDALLRAFREFKIRIAFITPALLKYILAESPNTIGNLDTLLVAGDRADIDDFFTARNLVTNKVVNAYGPTENSVMSTLYMLSDHEDCVNGVPIGRSISNSGAYVMDPEQNLVPLGVVGELVVTGDGVARGYTDPNRNVDRFVTVTVGNQTVRAYRTGDYVRQRPTDGEMEFFGRIDGQVKIRGNRVELGEIESVLRGHNFVRDAVVVAEKQQEKDQRLFGYVTLKEGSEMPAGKNSDSNQIQHVSAWEDRFNTEIYAPISSIESGTIGQDFIGWTSMYDGSDIDNTEMKEWLNETINAIHTKAGGRLGNVLEVGSGSGMILFNLGNTLEHYTGFEPSRKAVDFIMGTARSIPSLANKVEMYKATAADISQVDPPLRADTVILNSVVQYFPSQEYLFNVIRDLLQVTGVKTLFFGDIRSHALRREFFAARALFMAGERASKEDLRRMVEDMEQIERELLVDPGFFTSLASRLPDLVQHVEIQPKQMKATNELSSYRYTAVVYSRSWSPPSGALRTIPGHEWVDFKDQKLDRVSLQQRIKDVSSTHPMAISNIPCSKTIFGNRLLSSLEDEKARKPVHMDWSALIDKEVKQTPSFSAVDLDEMAKEAGCQVQISWNRQYSQQGGLDAIFYPRPVNGDASKSELMFSFPTDHTDRPQQTLSNKPMRQQLVKEVQQQLDELVKLQLPSYMAPQSIQVLDKLPINQNGKVDRKALAQRTKTNVVVGQDAQQRELTPAELKVQKILARVLGIDASRVGLEDSFFQLGGDSIAAMKIVAAAREEDIQLTVANIFQHPKLVNMATVAQFSQVVAEEKPTQPFSFLSPTEKEHLLQAIPANTSKVDRNDIVDVLPTTWMQNLFISRGVNVLPLAFNYFFLDLGTRVDVSRLRRSIPALVKHFSILRTKFVYVDGVLWQTVLRNPEVPFIKFELDMPLDEAADTVCLEDSRTTEPLELATAFLLVRSSSGEYRLVIRITHAQYDGVCFPSFIKTLFAIYSGKPVEPTHSYSNYLAYIRGRRSVSSQYWRNLLQGSRITKITTLLGPSIRHGNHPVEIQTQSIIGMPHVPTGFTLASIVSSAWARVLSQITGEEDVVYGYMIAGRNANIPNITKIVGPCLNIIPVRAQVHPTTSSTDLVRAIQEQYIALGEADSMGFDDIVRTSTDWPADAHYDSVFQYQNLNEHPVFDFEGTDSRLHWFQNPDSVPAILTVVAYPLEDGLRIVVRGNEHMITPDGADLINKSLCEMIGKVSSSLQEA

SEQ ID NO: 23 - DNA, 17477 bp, Cochliobolus heterostrophus
  CDS (1001)..(16477)
gggctccggatcgggttctgggtatgccaatctacttgtcatctcgatgggatgcatatcgtgtacagtcatactaccattgagatcattttttttgatcatctgttgcagcaaagccttaaccatttacagccctcaaatcttttgggacttgttcagcggcgtgtgctacacaatacttcattatctgtagtatgatttcgcatatcgggtttcctgttaaaaagaccatgactggcagtcatatccttgaactgtaatgtaaatcaggattttgacagctggaaatgaggtattgtggccgaactgcggcactgcaagaaactttcctctgattacaatccggaacatctgttctagcatgatatctagcgggctaatattattagaactatatagtgacgatctatacgatcaaagcgacgttcccgattctgggaagtttcgcaagtccctcggaactaggtggcaatgaaggagcacaataccaaaccagcctgtggccgatagggcctttctgtacccacaacgcaagtgggccacagtgtagactctggcatacgcggcaacaatcgaatctagaaaatttcaaggcgctttcacggctgtactcgtattgattgtggagacataacagccatggtaacgagccagatctcatttccaatatggaaataagtatgtagcaggttgtggagagatcgtgattgtgctattgtagtcgaatcgacgatcgagatggccgtgtatatcgtgagatgtactcagtatcttggcgttttgatacattgttcttgtcttgtggtaatatcggccgatcgattccaatctgtcaaacaatccttgcggttttctccccctacttaaatactgcagaatggcatgcccaaaccccgatgttcaaaatcttcagactgagatcaacagcttcagcagttttgtatctcactctttctcacccaaaccattgatttaacaagacaaaacagccattttcacaatgggtgatttcggaaacccactagagctcgacatggataagcgtgatatcgaccaaatatgggagagaaactttgggatcataccagcagttgagtattgcgttcacgacttgtacatagagcaagcaaaagttcgacctaacgcgcctgccatctgcgcatgggacggcgaaatgacttacaagcaattggatgagcactcaacgcaactagcgggctacctagctggtcaaggtgttatagctgaggaaatggtaccattgtgctttgagaagtcacagtggacagtggtagccatgcttgctgttctaaaagctggcggtgcgtttgttccgctagatccgtctcacccaaggtctcgccacgaagagatattcaaacaaaccaaagctaaggtggtactcacttctgtacaatatgcgaatctttggccaaattcaacgcaacggattcttgcagtcagcaacgccttcatcaaccagttatcagccgagactaaagtttgttccaaagtcgagccatggaatgctgtatatgtgatgttcacatctggcagtactggagttccaaagggcgtcgtcttggagcacggagcaatcacgacaagctgtctagctcacggaaaatcaatgagacttggacctaactctcgagccctccagtttgcggcttatactttcgatatctgcatcgctgagatattcactacattgatatttggcggatgtatctgcattccctcagaagacgaccgacgtaacgccttgtcagaattcatcaacaacagaaatgtcaactgggcacaactcacgccaacagtcgcgcgtctacttgatcccctaacagttccgaccctaaaagtactcgtccttggaggagaacgagtggacgacgccgactggaaaagatgggatggcaatgtcgcacagataaacgtatatggcccaacagagtgtagcatttggtgcacttcacatgaaaacactggtccggatttccagtcagggatgatcggcagatcaatggcttcagtcagctgggtgactaacccagacaaccacaaccagctggtgctcttcggcgaggttggagaacttctagtagagggaccaattctagcacgtggctatctcaacgacacaatgaagactgaggctgccttcgtcagcaacccctcctggctgatgcagggtagcgacgaccgtactggacgccagggaagattatacaaaacgggagatctagtctactataatgcagatggcaacttagtctatgtaggtcgaaaagatagccaagtcaaggtgcgcggccaacgagttgagttgggtgagattgagcaccacctccaccaatgcatgccaggcgtcaaacagttggcggctgaggtcattttaccaacgggagaccagggcaaagcaatggtagcagcatttctgcagctgagcgaagagacacatcatacacccatcagccagatttctgacagcaactccgaggtgcaagtcatctttcctacccaagtggacgagcaattggctcagagactaccaagagatatggtacccgaagtatactttgcagtgacggaatttccattgacaacgtccgccaaagtagacaggcagcggttgcgtaagattggggcatcattttccgcacaacagttggcccagttacggacgcgaggtgatggtctaaagcgacaaccagacacagaaaaaggaaagatactgcagcaactatggtcgcaggtacttagcattgatccaaggttcatcggtatggatgacagtttcttcagcctgggcggcgactcaatcgcggctatgaagctggtgggcgaagcacgcaggtcagggatacagatcagcgttgcaatcgttttccgcaatcccaagctggatcagttgacctctgcagcagttgtcttggctggaagctctacttctctcattccgcacgttggcagtgatgggcctgttgagcaatcattcgcacagggccgaatgtggttcttggaagaactacaccctggtctgacatggtatctcatgccagttgtggtgcgtattcggggcccgctgcagctctcagcgctagaatctgcactaaatgcgattgaaaaccgtcatgaaactctccggacaactttcgaaacagttggagacgcaagcatgcaggtggttcagccgttccatcctagggcaatgaacgtcatcgacatagacgaacatagcctcacagatgctgtgcaccgagaccagacaactccttttgacctacgcactgaggctgggtggagggtttcgctctatcgcattagcaaagaagaccatatactatctattgttatgcatcatattgtctctgatggctggtccactgatgtacttacgcgagagttgggcatattctattcagccctaatacaaggccgggatccgctttcttgtgtgcaacctctgcctatccagtatcgggatttttcagtgtggcagagacaacaagcgcagattgacaatgaccagagtcagctcgaatattggtctaatcagctgaataccagcaggccagctgagctgctgtgcgacaaaccccgacctactgctctatctggacaggccggaaaagaaaagattaatatcgatggcccactatacaataagctgcagcaattctgcaaagctcacggggtaacacagttcatggttctatttgcagcctttagggctacacacttccgtctaactggtcagaacgatgcaactataggcaccgtgaatgccaaccgagatcgatgggagctaaaagacatgattggcttctttgtcaacttgcaatgccttcgaactacaattacggacgagtcattcgaagaactggttcagcaagtccatgaagtaacgattgcttcccttgccaatggagacgttccattcgaaagcatcgtctctaagttaaagaataccagagacatgtctcgtcatccgattgtgcagctcatttttgccgtccactcgcagcgcaaattggggcatctgacactggagggcatgagaacagagagtcttgacaatgcaccaaagtcaagattcgatattgagttccacttcttccagcaagaagacagcctaaagggtgatgtcgtctattcaaccgacctctatacgccagagacaattggcaacatgctatcagttttccaaatcgttcttgaggggtgcctacaagatccgaaagctgcaatcgcctccttaccgttgttgcgcgaagccaactactccaagctcaaagacttaggtcttcttcatgttgagagaactgattacccacgtgattccagcatagtcgatctcttccaccagcaagtatcaatctgtccgtccaggattgctgtcaaagacccgctgagagagatgacttatgcgcagcttgacaaggaatctgaagttctctcttggtggctagctaaacagtcgctcgctccagagacattggtaggcgtattagcaggtcgaagctgccagaccattgttgcatttttgggtatcttgaaggccggcttggcgtacctaccgtttgatgtcaaactaccagcgaagcggatggaaaccattctctcctcactaccaggccagaaaattgtgctttttgggactgacgtagagcctcccaaattgaagatcggtgatgtccggttcgtacggatcgcagaaacactcgacgagcagatccgcaaaccatccgattccggaaatatcgtcaagccttcagcaactagcatcgcctatgtcatgtttacatcgggatcaacaggtcaaccgaagggtgccatgattgaacatcgtggtattgtgcgtttagtaagagacaacaactttgtgcagcacctgccggcctcaccagtcatggcgcacatgacgaatcttgcattcgatgtctccacgtgggagatatatgcctctctcctacaaggtggaacactagtctgcatcgacagaatgacagtgttggatccagaagctgtgttgcgaacattccgtcgagaacaagtccaaacggcattcatgacaccgtcccttttcagaacctacgttcagcaatcacctgcaatgtttgctaatctcgagatgctttgtgttggtggcgaagcacttcaatcaaatgatattgtttccataaagacacttcgtacaggcaagatcgtcaatggctatgggccgactgaaaatacaactttcagcacaattttcgttctatcaaaagacgacgagtacgcaaatggcgtacccattggccgtgcgcttagcaattctggcgcctacgtcatggatttgaagcagcaacttgtcccccttggtgtcgttggagaacttgttgtcacgggcgatggcctggcgcgtggatacactgatcccaagcgcaacattgaccgctttgtcacagtcgagattgacggtgagaatatgaaagcttaccgtacgggtgattacgtgcgttatcgtcctacagacggccagctggagtatttcggacgaatggatggacaggtcaaaattcgaggacatcgcatcgagttaggcgaaattgagcatgttctccgcagccataagtcagtaagtgaggcagtggctgtagtgcagcagcagaatgtagacgaggctactcgactagctgcgttcgtcacagtcttcgagggcgacgtagtagctgacgaagagcctaacgacaacgacgagtcacagcacgtagacacatgggaggatcagtttgattcgaaggtctatatgcccatttccaacgtcctctctgaagctgttggacgagacttcattggatggacttccatgtacgatggtagcgccatagataaggtagagatgaatgaatggctggacgagacaatcgacacaatactcaacggcggtaaacctggcaaagtccttgaggttggtacaggaactggtatgattcttttcaacttaagagacggcctggaaagctacattggactagatccatcccaaaaagctgttgatttcgtcaaagaaacagccaggtccatacctacgctagcagacaaggtcagagtctacaaggccacggcggcagaacttgatcgcttaccacctattgatgcaaaccttgttgttatcaattcagtcgttcagtatttcccaagcttggattaccttttcaagaccgtgcaacagctgctcgaaatagagggcgcctctactctcttctttggcgatgttcggtcttatgcgctacaccgggagtttctcgcaacacgggccttgttcatggctggcgacactgcagaaaaggctgatatccgtcgcatgattgccgacatggagcgagttgaaagagagcttctggtagatccaggtttcttcactgctctgccagagcgtctaccaggccttatcgagcatgtcgaaatcttgccaaagaaggtaaaggcaacaaacgagctaagctgttaccgttacgcagccgtcgttcatgttaagtcgcgaaatggacaaaagcaagagcaggtaattcgagatgtggggcatgacgaatggatcgattttgctgaacacaagctggaccgaccgtctctcttgaagcaacttcaaaacctttccagctcatccactgtggccgtgagcaacattccttatagtaagacgattgtgagccggtgccttattgactcattggacggtgccatagcagagacgtctgatgcatcaagctggctctcatcagtgtatcggcaagcggaaaactgtccctctttgtctgctgctgagctacatgagttggcagcagaggcgaattgccacgttgagattagttggaacagacagcactctcagcgcggaggtcttgacgcgatattccatcgctatcaaccacaaaagggagagaacagagttatgtttcgattccccactgaccatgcagagcggcctctacataacctgggcagcacgccattacggcaacaggtcttgcagaggacccaaaaacaactccaggagatacttgaagcccagctacccgcttacatgattccccagacgatcacgttcctggacgcgatgccaaccaatcagaacggcaaggtggaccgtagcgctcttacacagagaacggaaatccagacagtagaaggccaagaattccaacgagaattgactagggcagagctcaaggttcagcaactgatggctcgcgtactttgcatcaatgcgaaccgcattggtctcgatgatagctttttccagctaggcggtgactcaattgcagccatgagattggttgctatggctcgtgaggaagatatgcaaattacggtcgcaaaagttttccagtaccctaaagttattcaactagccgctgtggctcaggagcatgtacacattcctagggacaacatcgccccattttctctactcgaccccgaggttgatgcaacgcagacacaccaagatgtagcgaatagctgcaaagtcgacagaggtcttgttgaagatatctacccatgctcgccgcttcaggaaggcttgatgtcgctgactgtgaagcggccgggtgattacatcatgcagacagtgctggaactgcggccagatgtggaagaagcagccttccaaattgcgtgggagaaaacagttcagtcattgcaaatattacgaacgcgcattgtagtacataagacccttggtctgttgcaggctgtcgtggcagacaaaatgaagtgggcagaagcagacgatctggccacctacctagctcaagacaagctgttatctatgcagcttggtgagccacttgcacgctatgctctggtacgagactctcataaagaaaagcggtggttcgtatggacaattcaccatgctatatacgatggttgggcgctggcccacattctgaacgctgtacaaacggcgtataatggcgcagagctagagaagcaatttgggttcaacaacttcatcaagtatcttgagcagctagatcaagatggtctcgcatcatactggagggctacgcttagcgactgcgaggccaatgttttcccaccactacaatctagggtgcaacagccagtggcagatgcgacagctgaatatcaatgccctccacttcccaaaagaacctcaaacactaccatttcaacacttattcgcacagcctgggcgattgttgctagcgcctatacgaattcagaagacgttgtgtttggagcgacagtcacaggccggaatgcaccagtggcgggcatcgagtccttggtcggacctgtgattgcaacagtgccggtgcgaatacgtctacaaagggacctgactgttctagagcttctcgaaacggtacagaaacaagcaaccgaaatgattccattcgagcaaaccggattgcagcggatcactaagctagtaccagaagcccaacatgcctgtagctttcagacacttctgattgtgcagcctgcagaagacgcattccaaacagacaacatgtttggaaagtgggaatttggctcagggctacaagacttcacgacgtatgcgctaatggtacaatgcaagctagctaaagagggggttagaatcacggccagtttcgatgcgcggttggttgaacagtggcaggttgagaagatgctggctcaactaagcttcgtcatgcagcagttggcccgaggagacctaaacacaagagtcaaggacattgaaataatcacaccaagtgacgaacaacagctgtggaattggaatcacaagttaccgccagctatcgagcgttgtgtccatgatctatacttggaacaagtaaagtctcagcccaaagcagatgcggtatgcgcatgggatggtagaatgacatatgaagagctggacgaaacatcatcgcgccttgcacaccatttgatcagccttggggttgaatcagagagcatagtccctctttgctttgataaatcgatttgggttgttgtagctatgctggctgtgctcaaaacaggcggcgcctttgcacccctggatcccaatcatccaacatctcgtcatcgagagatcttcgaccaaaccaaagccaagatgattctctcctcgacacagtacgccaatctctggccagaaagttctcaaatcgtcgtgccaatcagcagagacttcattgatcagttgccggccaagccttacgacgctcagatagcggtccagccagggaacacagcgtatattatctttacatcaggaagtactggagtgcctaagggtgttcaactagagcataaggctgtttccacaagttgcctataccaaggacctgctttaggaatcacaaagaatactcgagctcttcaattcgccgcctatacatttgacgcctgtattctagagatcattacaagtctattacatggtgcttgtgtatgtattccttccgagagccagcggcgcgacaatctcatcgacacaatcaatgccatggaagtcagctgggcactgttgactccagccgtcgcgagaatattggacccagagaagattgtgtcgctgaagacgttggttcttggtggtgaaaaggtcaacgcttcggactgcgaaatctggagtgaccgcgtacaactaatcaacgcttatggacctacagaatgctgcgtctcttgtgtcgcaaatcccgatatgaaagggcttgatccggaacctatcggaaattcagttgcatcagtcagctgggtagttaatccagacgatcacaataggctagctccgctaggcgcagtgggtgaactgttggtcgaaggaccaaacttagcacgcggctatctgaacgatgctaagaaaacagaaaccgcctttatcaatgaacctccctggctacttcgaggcagtgaaggctatagtgggcgacgaggcagactgtacaagacaggtgacctagtgcattacactgcagatggtagtttggtctacgttggccgcaaagacaaccaggtcaaagtgcgtggccaacgcattgagcttgctgagattgagcatcatctctatcaatgcctgccagatatcaaagaaatcgcagttgaagtgattttaccaacaggagggaagccgatagtagcagcgttcctagaagcaaattccgagctactcaacagcaagaagtcggatagtggctccggagttcatgttgtgtttccagcccaagcagaggacgaattatctcaacggttaccccgggatatggtgcctggaatttactttgcgctcgtagagtttccaatcatgacgtctggtaagatcgatcgaaagcgactacgcgaaattggacgctcgttttcagcacaacaactagcccagttgcaaacacagagaggcgagggcctaaaacgacagccagagacagagcaagagaaggtgttgcagcaactatgggcgcaggtgctaggtatcaacgctgcttctattggacttgatgatagcttcttccgactaggtggcgactcgatcgcagccatgaaacttgtgagcgaggcgcgcaatgttgacctgaagctttctgttcaggacgttttccacgcgcaacgactcggccaactggccaaacaatcacttcactcttccactgagagtgtaatcacaaaaggcaatcatcgggggcctgtcacccaatcgtttgcgcagggccgactttggttcttagaacaactgcatcctggactagactggtacctcatgcaccttgccgtacgtatcagaggcccatttcaactccaagcgcttcaagctgcgctacagacagtagagcgccgccacgaaacgctaagaacaacattttccaccaacaatggcgaaaatctgcaggaggtccatcctttccatgatggaaaagacctaaatgtcatcgacatcaactcaaacgacgaagctttgctagaagtcctggaattggaacaaaagacaccgtttaatctgcgaagcgagcctgggtggagagtatctgtctataggattgatggggagaaccatgttctgtctatcgtcatgcatcacatcgtttcagatggctggtcagttgatgttttgaagaaagaactgagcaaactgtacgctgctgcacttcgcggcgaagacctagactcctgcttaccacctttacccattcaataccgcgacttctctgtctggcagaagcttccaggtcaagttcaagagcatcaacgacagcttgactattggatcaaccaattggactcaagccgaccagcggaatttctctatgataagcctcggccagctactctttctggcaaagcaggcacacagaaactcactattagccacagactctatgaaaggttacaagattttgctagagaacgtggggtgactctgtttgtggtcctcctcactgtttttagagctgcgcactaccgcctgactaatcaggatgacgcgaccattggagtccccaacgcgaaccgaaatcgctgggaggttggggacttgattgggttttttgttaacattcaatgcctccgaattaagattcaggatgaaacctttgaagagttagtgcaacaggtctacacggcagtagtagactcactcgctaaccaagacgtaccttttgagaatatcgttgctgcattacaaggagaccgagatatttcccgcaatcctcttactcaggtcgcattcgctgttcactcacagcaagatatagggaagctttcgttcgatggtgtcgaaacagaagttatagagggcttagctacctcgcgttttgacctcgaattccatttcttccaggaacaggacagtcttcaaggctatatatacttctcagaggagctgtttgctcctgagagtatacgttcgctagcatccgtctttacaagcattcttgacaactgtctggccaagccagaaacgcagattgcgatagccccactcatgaccgaccaagctcatattcagctcgatcatatggggctcctcagcatgaatgagacggcctattcccgagattcaagcattgtcgatgtcttccgccagcaagtcgctatgcaaccgtctagaattgctgttatagatgcatttacagaactgacatacactgagctagacgcacagtcagaaaagcttgcaaaatatctagcgacaaaatcacttgctcttgaaacagcagttggtgttctggcacaccgaggctgtgaagcaattgttgcctttttcggtattcttaaagctggattagcttacctgccattcgattcaaaagcaccagaaaagcgcatggaatcaatcctatcaaccattgatggaaaaaagctagttctggtcggcccaaacattcggttgcccggtgcaggactcgaggatgttgagtttgctcacattgtcgacatcttgaacgtagacgataatgctgagttcataagaagggagcttgatcccgctctcaaacccagtccttctagccttgcttacattctatttacgtctggctctactggccagcctaaaggagtcatggtcgaacatcgtggcatagttcgcctggcacaacacgaccagatggagcactttagatcatccgaagccacggctcatatggcaaatcttgcttttgatggatcttcctgggagatttatacctgtcttttgaacggaggaactttggcttgcattgatgcgacaactgtcctagaccaagatgccctattgcgcgcgtttagggaatacaagattcggatcgcttttatcacgccagctttgctgaaatatatcctagccgaatcgccagacacaatcggcaacttggatactctccttgtagcaggagacagagccgatataaacgacctctttaccgcaaggaatcttgtgacaaacaaggttttcaacgcatatggccctactgagaactcggttatgagtacactatatttgctttcggacaatgaggcttgtgtcaacggtgtacctattggacgatcaatcagtaactcaggagcatatgtgatggacccagaacagaatcttgtaccacttggtgttgttggggaactcgttgtgattggagacggtgttgccagaggatatactgatccaaatcgcaacgtcgaccgtttcgtgactataacagtcggaaaccagacaatgagggcatatcgtacgggagactacgtccgccagcgacctactgatggagagatggaattctttggtcgcattgatggtcaagtcaagatccggggcaaccgtgttgaactaggagagatcgagagcgtcctgcgcggtcacaactttgtgcgcgacgcagtggtagtagcagaacaacaacaagaaaaagatcaacgacttttcggttacgtcactctcaaagaaggatccgaaatgcctgccggcaagaacagcgatagcaaccaaatacagcatgtcactgcgtgggaagaccgcttcaacaccgagatttacgccccgatcagccatatcgagtctggaacaattggtcaagattttattggatggacctcaatgtatgatggctccgatatcgacaagacggaaatgaaggagtggttggacgaaactattaacgcaatccacaccaaagccggtggaagattaggaaacgtagtcgaaattggatcaggatccggcatgatcctcttcaacctcggaaataccctagaacattacaccggatttgagccctcaaaaagggcagtcgacttcattatggggacagcaaggtctatcccctcactggccaacaaagtggagatgtacaaagcgacagccgctaacattagtcaagtagatccgccgctgcatgctgacatggtaattctaaactctgttgttcagtactttcctagccaagagtatctgtttaacgtggtccgagaattacttcaagttactaatgttaagacattattctttggcgatatccgttctcatgctctgcgccgagaattctttgcagctagagctctctttatggctggtagacgggctagcaaagaggaactacgacgtatgatggaggatatggaacaaattgaacgggagctgttggttgatccgggcttttttacttcgctagcacatcgccttcctgatttggtccagcatgtggagattcagcccaagagaatgaaagcaacgaacgagctgagctcttaccgctatacggcagtggtttactctcgatcttggactccgccgtccggggcacttcaaactatccctgacaatgaatggaccgattttaaagaagagaacttggaccgtggatctcttcagcagcggataaaggatgttccaagcacaagtcctatggccataagcaatataccctgcagcaagactgtctttggaaatcgccttctaagctctttggaagacgaaaaagccagaaagccagtccacatggactggcatgctctgattgaccaagaaataaagcaaattcccagtctttctgctgttgatctggatgaaatggccagagaagtaggctgtcaggtacagatcagctggaacagacaatattcacaacagggtggcctggatgctatcttctaccctcgtcaaatcaatgacgatgctggcaagtctggactgatgttttcattcccaacggatcacacagatcggccacagcaaaacttgagcaacaagccaatgcggcagcaactcgtcaaagaagtccaacagcagctcgatgagcttgtgagacttcagctaccttcatacatggttccacaatccattcaagtcttggataaacttccaataaatcagaacggcaaggtggatcgaaaagcccttgcacaaagaacaaaactgagtgtcgtggttggccaagacatccaacaacgagaactcagccctgcagaagtcaaagtgcagaagatactggcgcgagtacttggaattgacgctagtcgtattggattggaagacagcttcttccagctaggtggagactcaattgcggctatgaagatagtcgcagcagctcgagaagaggacatccgactcacagttgcgaacatcttccagcatcccaagctcgtcaacctagccactgtcgctcagttctctcaaagtgtagctgaagagaagccgactcagccattctctttcctctcgccaactgaaaaggagcatctcctccaggctatacctgcgaatacttccaaggtagacagaaacgacattgtcgacatccttccaacgacatggatgcagaatctgttcatttcccggggtgtcaacgatctagccctagctttcaactacttcttcctcgacttggggacacgtgttgacgttgctcgcctcagacgcagtatcccggctcttgtcaaacacttctctatccttcgcacaaagtttgtttatgtcgacggagtattatggcaaactgttcttcgcgaccctgaagttccctttatcaagtttgagcttgatatgcctcttgacgaagcagcggacactgtctgcttagaggacagtcggaacacggagcccctggagttggctactgctttcttgttggtaaaaagctcctcgggcgaacaccgtttggtaatccgcattacacatgctcagtacgacggtgtttgtttcccgtccttcataaagacgctttttgccatttactctggcaaacctgtagaggctacgcacagcttttcaacctatctagcctacactcgggggagaagatcaatctcatcacagtactggcgtaacctcctccaaggctcacggattacaaaagtcacctcgttgctcggtcctagcattcggcgtggcaacaatccaattgaaatccagacagaaagtatcatcagcatgccccacgtcccaactggttttactctagcctcgatcgtcagttcagcctgggcaagggtgctctcaaaaatcaccggagaagaagacgtcgtctatggatacatgatagccggccgcaacgcgaacattccaaacattacgaaaatcgtcggtccctgcttgaacatcatccccgttcgagcccgagtccatccaacaacttcgtcaactgacctagtgcgcgcaatccaagaacaatacatcgcactcggcgaagccgattcaatgggcttcgacgacatcgtgcgcacatccacagactggccagccgatgcgcattacgactcggtgttccagtaccagaacctgaatgaacacccggtatttgatttcgaaggcacagattctagactgcattggtttcagaatccggattcggtaccggctatcttgactgtggtggcctacccgcttgaggatggactcaggattgtggttaggggtaatgagcatatgattacgcctgagggtgcggagttgattaatacatcgctctgtgagatgattgggaaagtgtcttcttcgctgcatgaggcgtgaaaagattaggacaggatgaggataatgcaagggttaattaagagccacttgggcagagcacttggcatggctggagcttggggtgagatactctctagatagcagctacgaggttgtctgatcttctttcaggaggccagctttgatggtggatttggcgtactggggatggatttctttactacacaaaattattgtcaataaagatatgtcgtgcgatgtgttatactacgtcacttgattaaattgatttttgaatacgcaaaattttgttaaaactcactgtgaaagctctcggctaatatgatggtcgcagcatttatgacattacgatctgctactctttcagcactcttacatagctacataggtgttgtgagcctttcaacccatcttccaactatggaggacttagtctccaccaaacccttgcctggagcttcgttcatgtcaactgtagatttagccatatattacgtcggcatatcgtcttgttgctgagatctcagtggttgcgcttgctaccacacctaaagaaatctccttgagccatggagccactccttgcacttcatgcggcgaaacatttatttcacagctaggatgttcagtgttactaataaaaccccagaaaacaataactgttagcgccatctcttgtatattcaatgattgttggtgattttaccactctgtgtggagcttgcgcgatgatcctggctcgtgcatagggctggtccggttctcgcagcatccatcctacgtacatgcagctcgatctttattcacacacatgtacaccatctactcaacgacctaaaccgctcgctgccttgttgtcgcactccatttacgatactcatatttatattggactgcggaaacactccttggacgttcacaactgcgcgcataaggccgcgcagcgcaacaaatgcccgctcccgcgtcaaacaagcgcgtcaaggtaagcaacttgcgcgttgctccaaaagctatg

SEQ ID NO: 24 - protein, 5158 aa, Cochliobolus heterostrophus
MGDFGNPLELDMDKRDIDQIWERNFGIIPAVEYCVHDLYIEQAKVRPNAPAICAWDGEMTYKQLDEHSTQLAGYLAGQGVIAEEMVPLCFEKSQWTVVAMLAVLKAGGAFVPLDPSHPRSRHEEIFKQTKAKVVLTSVQYANLWPNSTQRILAVSNAFINQLSAETKVCSKVEPWNAVYVMFTSGSTGVPKGVVLEHGAITTSCLAHGKSMRLGPNSRALQFAAYTFDICIAEIFTTLIFGGCICIPSEDDRRNALSEFINNRNVNWAQLTPTVARLLDPLTVPTLKVLVLGGERVDDADWKRWDGNVAQINVYGPTECSIWCTSHENTGPDFQSGMIGRSMASVSWVTNPDNHNQLVLFGEVGELLVEGPILARGYLNDTMKTEAAFVSNPSWLMQGSDDRTGRQGRLYKTGDLVYYNADGNLVYVGRKDSQVKVRGQRVELGEIEHHLHQCMPGVKQLAAEVILPTGDQGKAMVAAFLQLSEETHHTPISQISDSNSEVQVIFPTQVDEQLAQRLPRDMVPEVYFAVTEFPLTTSAKVDRQRLRKIGASFSAQQLAQLRTRGDGLKRQPDTEKGKILQQLWSQVLSIDPRFIGMDDSFFSLGGDSIAAMKLVGEARRSGIQISVAIVFRNPKLDQLTSAAVVLAGSSTSLIPHVGSDGPVEQSFAQGRMWFLEELHPGLTWYLMPVVVRIRGPLQLSALESALNAIENRHETLRTTFETVGDASMQVVQPFHPRAMNVIDIDEHSLTDAVHRDQTTPFDLRTEAGWRVSLYRISKEDHILSIVMHHIVSDGWSTDVLTRELGIFYSALIQGRDPLSCVQPLPIQYRDFSVWQRQQAQIDNDQSQLEYWSNQLNTSRPAELLCDKPRPTALSGQAGKEKINIDGPLYNKLQQFCKAHGVTQFMVLFAAFRATHFRLTGQNDATIGTVNANRDRWELKDMIGFFVNLQCLRTTITDESFEELVQQVHEVTIASLANGDVPFESIVSKLKNTRDMSRHPIVQLIFAVHSQRKLGHLTLEGMRTESLDNAPKSRFDIEFHFFQQEDSLKGDVVYSTDLYTPETIGNMLSVFQIVLEGCLQDPKAAIASLPLLREANYSKLKDLGLLHVERTDYPRDSSIVDLFHQQVSICPSRIAVKDPLREMTYAQLDKESEVLSWWLAKQSLAPETLVGVLAGRSCQTIVAFLGILKAGLAYLPFDVKLPAKRMETILSSLPGQKIVLFGTDVEPPKLKIGDVRFVRIAETLDEQIRKPSDSGNIVKPSATSIAYVMFTSGSTGQPKGAMIEHRGIVRLVRDNNFVQHLPASPVMAHMTNLAFDVSTWEIYASLLQGGTLVCIDRMTVLDPEAVLRTFRREQVQTAFMTPSLFRTYVQQSPAMFANLEMLCVGGEALQSNDIVSIKTLRTGKIVNGYGPTENTTFSTIFVLSKDDEYANGVPIGRALSNSGAYVMDLKQQLVPLGVVGELVVTGDGLARGYTDPKRNIDRFVTVEIDGENMKAYRTGDYVRYRPTDGQLEYFGRMDGQVKIRGHRIELGEIEHVLRSHKSVSEAVAVVQQQNVDEATRLAAFVTVFEGDVVADEEPNDNDESQHVDTWEDQFDSKVYMPISNVLSEAVGRDFIGWTSMYDGSAIDKVEMNEWLDETIDTILNGGKPGKVLEVGTGTGMILFNLRDGLESYIGLDPSQKAVDFVKETARSIPTLADKVRVYKATAAELDRLPPIDANLVVINSVVQYFPSLDYLFKTVQQLLEIEGASTLFFGDVRSYALHREFLATRALFMAGDTAEKADIRRMIADMERVERELLVDPGFFTALPERLPGLIEHVEILPKKVKATNELSCYRYAAVVHVKSRNGQKQEQVIRDVGHDEWIDFAEHKLDRPSLLKQLQNLSSSSTVAVSNIPYSKTIVSRCLIDSLDGAIAETSDASSWLSSVYRQAENCPSLSAAELHELAAEANCHVEISWNRQHSQRGGLDAIFHRYQPQKGENRVMFRFPTDHAERPLHNLGSTPLRQQVLQRTQKQLQEILEAQLPAYMIPQTITFLDAMPTNQNGKVDRSALTQRTEIQTVEGQEFQRELTRAELKVQQLMARVLCINANRIGLDDSFFQLGGDSIAAMRLVAMAREEDMQITVAKVFQYPKVIQLAAVAQEHVHIPRDNIAPFSLLDPEVDATQTHQDVANSCKVDRGLVEDIYPCSPLQEGLMSLTVKRPGDYIMQTVLELRPDVEEAAFQIAWEKTVQSLQILRTRIVVHKTLGLLQAVVADKMKWAEADDLATYLAQDKLLSMQLGEPLARYALVRDSHKEKRWFVWTIHHAIYDGWALAHILNAVQTAYNGAELEKQFGFNNFIKYLEQLDQDGLASYWRATLSDCEANVFPPLQSRVQQPVADATAEYQCPPLPKRTSNTTISTLIRTAWAIVASAYTNSEDVVFGATVTGRNAPVAGIESLVGPVIATVPVRIRLQRDLTVLELLETVQKQATEMIPFEQTGLQRITKLVPEAQHACSFQTLLIVQPAEDAFQTDNMFGKWEFGSGLQDFTTYALMVQCKLAKEGVRITASFDARLVEQWQVEKMLAQLSFVMQQLARGDLNTRVKDIEIITPSDEQQLWNWNHKLPPAIERCVHDLYLEQVKSQPKADAVCAWDGRMTYEELDETSSRLAHHLISLGVESESIVPLCFDKSIWVVVAMLAVLKTGGAFAPLDPNHPTSRHREIFDQTKAKMILSSTQYANLWPESSQIVVPISRDFIDQLPAKPYDAQIAVQPGNTAYIIFTSGSTGVPKGVQLEHKAVSTSCLYQGPALGITKNTRALQFAAYTFDACILEIITSLLHGACVCIPSESQRRDNLIDTINAMEVSWALLTPAVARILDPEKIVSLKTLVLGGEKVNASDCEIWSDRVQLINAYGPTECCVSCVANPDMKGLDPEPIGNSVASVSWVVNPDDHNRLAPLGAVGELLVEGPNLARGYLNDAKKTETAFINEPPWLLRGSEGYSGRRGRLYKTGDLVHYTADGSLVYVGRKDNQVKVRGQRIELAEIEHHLYQCLPDIKEIAVEVILPTGGKPIVAAFLEANSELLNSKKSDSGSGVHVVFPAQAEDELSQRLPRDMVPGIYFALVEFPIMTSGKIDRKRLREIGRSFSAQQLAQLQTQRGEGLKRQPETEQEKVLQQLWAQVLGINAASIGLDDSFFRLGGDSIAAMKLVSEARNVDLKLSVQDVFHAQRLGQLAKQSLHSSTESVITKGNHRGPVTQSFAQGRLWFLEQLHPGLDWYLMHLAVRIRGPFQLQALQAALQTVERRHETLRTTFSTNNGENLQEVHPFHDGKDLNVIDINSNDEALLEVLELEQKTPFNLRSEPGWRVSVYRIDGENHVLSIVMHHIVSDGWSVDVLKKELSKLYAAALRGEDLDSCLPPLPIQYRDFSVWQKLPGQVQEHQRQLDYWINQLDSSRPAEFLYDKPRPATLSGKAGTQKLTISHRLYERLQDFARERGVTLFVVLLTVFRAAHYRLTNQDDATIGVPNANRNRWEVGDLIGFFVNIQCLRIKIQDETFEELVQQVYTAVVDSLANQDVPFENIVAALQGDRDISRNPLTQVAFAVHSQQDIGKLSFDGVETEVIEGLATSRFDLEFHFFQEQDSLQGYIYFSEELFAPESIRSLASVFTSILDNCLAKPETQIAIAPLMTDQAHIQLDHMGLLSMNETAYSRDSSIVDVFRQQVAMQPSRIAVIDAFTELTYTELDAQSEKLAKYLATKSLALETAVGVLAHRGCEAIVAFFGILKAGLAYLPFDSKAPEKRMESILSTIDGKKLVLVGPNIRLPGAGLEDVEFAHIVDILNVDDNAEFIRRELDPALKPSPSSLAYILFTSGSTGQPKGVMVEHRGIVRLAQHDQMEHFRSSEATAHMANLAFDGSSWEIYTCLLNGGTLACIDATTVLDQDALLRAFREYKIRIAFITPALLKYILAESPDTIGNLDTLLVAGDRADINDLFTARNLVTNKVFNAYGPTENSVMSTLYLLSDNEACVNGVPIGRSISNSGAYVMDPEQNLVPLGVVGELVVIGDGVARGYTDPNRNVDRFVTITVGNQTMRAYRTGDYVRQRPTDGEMEFFGRIDGQVKIRGNRVELGEIESVLRGHNFVRDAVVVAEQQQEKDQRLFGYVTLKEGSEMPAGKNSDSNQIQHVTAWEDRFNTEIYAPISHIESGTIGQDFIGWTSMYDGSDIDKTEMKEWLDETINAIHTKAGGRLGNVVEIGSGSGMILFNLGNTLEHYTGFEPSKRAVDFIMGTARSIPSLANKVEMYKATAANISQVDPPLHADMVILNSVVQYFPSQEYLFNVVRELLQVTNVKTLFFGDIRSHALRREFFAARALFMAGRRASKEELRRMMEDMEQIERELLVDPGFFTSLAHRLPDLVQHVEIQPKRMKATNELSSYRYTAVVYSRSWTPPSGALQTIPDNEWTDFKEENLDRGSLQQRIKDVPSTSPMAISNIPCSKTVFGNRLLSSLEDEKARKPVHMDWHALIDQEIKQIPSLSAVDLDEMAREVGCQVQISWNRQYSQQGGLDAIFYPRQINDDAGKSGLMFSFPTDHTDRPQQNLSNKPMRQQLVKEVQQQLDELVRLQLPSYMVPQSIQVLDKLPINQNGKVDRKALAQRTKLSVVVGQDIQQRELSPAEVKVQKILARVLGIDASRIGLEDSFFQLGGDSIAAMKIVAAAREEDIRLTVANIFQHPKLVNLATVAQFSQSVAEEKPTQPFSFLSPTEKEHLLQAIPANTSKVDRNDIVDILPTTWMQNLFISRGVNDLALAFNYFFLDLGTRVDVARLRRSIPALVKHFSILRTKFVYVDGVLWQTVLRDPEVPFIKFELDMPLDEAADTVCLEDSRNTEPLELATAFLLVKSSSGEHRLVIRITHAQYDGVCFPSFIKTLFAIYSGKPVEATHSFSTYLAYTRGRRSISSQYWRNLLQGSRITKVTSLLGPSIRRGNNPIEIQTESIISMPHVPTGFTLASIVSSAWARVLSKITGEEDVVYGYMIAGRNANIPNITKIVGPCLNIIPVRARVHPTTSSTDLVRAIQEQYIALGEADSMGFDDIVRTSTDWPADAHYDSVFQYQNLNEHPVFDFEGTDSRLHWFQNPDSVPAILTVVAYPLEDGLRIVVRGNEHMITPEGAELINTSLCEMIGKVSSSLHEA

SEQ ID NO: 25 - DNA, 33 bp, Artificial
  Synthetic DNA
cggtacccggggatccccacgtgcagcttcaac

SEQ ID NO: 26 - DNA, 33 bp, Artificial
  Synthetic DNA
atttaaatagttacaatattcgtggagtatccc

SEQ ID NO: 27 - DNA, 36 bp, Artificial
  Synthetic DNA
accgtcatggatatcctacggaccgagtgagaactc

SEQ ID NO: 28 - DNA, 39 bp, Artificial
  Synthetic DNA
cgactctagaggatccagagtatttagttggagggattg

SEQ ID NO: 29 - DNA, 24 bp, Artificial
  Synthetic DNA
gatatcgccgctctgcttcattgc

SEQ ID NO: 30 - DNA, 25 bp, Artificial
  Synthetic DNA
gatatccatgacggttgctagggtc

SEQ ID NO: 31 - DNA, 41 bp, Artificial
  Synthetic DNA
tgtaactatttaaatgcggccgcgcagttgccgttggacca

SEQ ID NO: 32 - DNA, 37 bp, Artificial
  Synthetic DNA
cagagcggcgatatccgcgacactgtaatattaaagc

SEQ ID NO: 33 - DNA, 15477 bp, Cochliobolus miyabeanus; identical to SEQ ID NO: 21
  CDS (1)..(15477)

SEQ ID NO: 34 - protein, 5158 aa, Cochliobolus miyabeanus; identical to SEQ ID NO: 22

SEQ ID NO: 35 - DNA, 43 bp, Artificial
  Synthetic DNA
cggtacccggggatcgcggccgcatgggtgacataggaaaacc

SEQ ID NO: 36 - DNA, 41 bp, Artificial
  Synthetic DNA
cgactctagaggatcgcggccgctcatgcctcctgcagtga

The invention claimed is:

1. A method for producing tentoxin, comprising the steps of:
culturing a transformant into which a tentoxin synthesis-related gene has been introduced, wherein the tentoxin synthesis-related gene encodes a protein having activity of nonribosomal peptide synthesis of dihydrotentoxin and containing the following modules in the order below from the N-terminal side:
a first module having a first adenylation domain comprising the amino acid sequence of SEQ ID NO: 1 or an amino acid sequence having 90% or more identity with the amino acid sequence of SEQ ID NO: 1, a first peptidyl carrier protein domain comprising the amino acid sequence of SEQ ID NO: 2 or an amino acid sequence having 90% or more identity with the amino acid sequence of SEQ ID NO: 2, and a first condensation domain comprising the amino acid sequence of SEQ ID NO: 3 or an amino acid sequence having 90% or more identity with the amino acid sequence of SEQ ID NO: 3 in that order from the N-terminal side;
a second module having a second adenylation domain comprising the amino acid sequence of SEQ ID NO: 4 or an amino acid sequence having 90% or more identity with the amino acid sequence of SEQ ID NO: 4, a first N-methyltransferase domain comprising the amino acid sequence of SEQ ID NO: 5 or an amino acid sequence having 90% or more identity with the amino acid sequence of SEQ ID NO: 5, a second peptidyl carrier protein domain comprising the amino acid sequence of SEQ ID NO: 6 or an amino acid sequence having 90% or more identity with the amino acid sequence of SEQ ID NO: 6, and a second condensation domain comprising the amino acid sequence of SEQ ID NO: 7 or an amino acid sequence having 90% or more identity with the amino acid sequence of SEQ ID NO: 7 in that order from the N-terminal side;
a third module having a third adenylation domain comprising the amino acid sequence of SEQ ID NO: 8 or an amino acid sequence having 90% or more identity with the amino acid sequence of SEQ ID NO: 8, a third peptidyl carrier protein domain comprising the amino acid sequence of SEQ ID NO: 9 or an amino acid sequence having 90% or more identity with the amino acid sequence of SEQ ID NO: 9, and a third condensation domain comprising the amino acid sequence of SEQ ID NO: 10 or an amino acid sequence having 90% or more identity with the amino acid sequence of SEQ ID NO: 10 in that order from the N-terminal side; and a fourth module having a fourth adenylation domain comprising the amino acid sequence of SEQ ID NO: 11 or an amino acid sequence having 90% or more identity with the amino acid sequence of SEQ ID NO: 11, a second N-methyltransferase domain comprising the amino acid sequence of SEQ ID NO: 12 or an amino acid sequence having 90% or more identity with the amino acid sequence of SEQ ID NO: 12, a fourth peptidyl carrier protein domain comprising the amino acid sequence of SEQ ID NO: 13 or an amino acid sequence having 90% or more identity with the amino acid sequence of SEQ ID NO: 13, and a fourth condensation domain comprising the amino acid sequence of SEQ ID NO: 14 or an amino acid sequence having 90% or more identity with the amino acid sequence of SEQ ID NO: 14 in that order from the N-terminal side; and collecting tentoxin from the culture supernatant.

2. The method of claim 1, wherein the transformant is a filamentous fungus into which the tentoxin synthesis-related genes have been introduced in an expressible manner.

3. A transformant, into which a tentoxin synthesis-related gene has been introduced, wherein the tentoxin synthesis-related gene encodes a protein having activity of nonribosomal peptide synthesis of dihydrotentoxin and containing the following modules in the order below from the N-terminal side:

a first module having a first adenylation domain comprising the amino acid sequence of SEQ ID NO: 1 or an amino acid sequence having 90% or more identity with the amino acid sequence of SEQ ID NO: 1, a first peptidyl carrier protein domain comprising the amino acid sequence of SEQ ID NO: 2 or an amino acid sequence having 90% or more identity with the amino acid sequence of SEQ ID NO: 2, and a first condensation domain comprising the amino acid sequence of SEQ ID NO: 3 or an amino acid sequence having 90% or more identity with the amino acid sequence of SEQ ID NO: 3 in that order from the N-terminal side;

a second module having a second adenylation domain comprising the amino acid sequence of SEQ ID NO: 4 or an amino acid sequence having 90% or more identity with the amino acid sequence of SEQ ID NO: 4, a first N-methyltransferase domain comprising the amino acid sequence of SEQ ID NO: 5 or an amino acid sequence having 90% or more identity with the amino acid sequence of SEQ ID NO: 5, a second peptidyl carrier protein domain comprising the amino acid sequence of SEQ ID NO: 6 or an amino acid sequence having 90% or more identity with the amino acid sequence of SEQ ID NO: 6, and a second condensation domain comprising the amino acid sequence of SEQ ID NO: 7 or an amino acid sequence having 90% or more identity with the amino acid sequence of SEQ ID NO: 7 in that order from the N-terminal side;

a third module having a third adenylation domain comprising the amino acid sequence of SEQ ID NO: 8 or an amino acid sequence having 90% or more identity with the amino acid sequence of SEQ ID NO: 8, a third peptidyl carrier protein domain comprising the amino acid sequence of SEQ ID NO: 9 or an amino acid sequence having 90% or more identity with the amino acid sequence of SEQ ID NO: 9, and a third condensation domain comprising the amino acid sequence of SEQ ID NO: 10 or an amino acid sequence having 90% or more identity with the amino acid sequence of SEQ ID NO: 10 in that order from the N-terminal side; and a fourth module having a fourth adenylation domain comprising the amino acid sequence of SEQ ID NO: 11 or an amino acid sequence having 90% or more identity with the amino acid sequence of SEQ ID NO: 11, a second N-methyltransferase domain comprising the amino acid sequence of SEQ ID NO: 12 or an amino acid sequence having 90% or more identity with the amino acid sequence of SEQ ID NO: 12, a fourth peptidyl carrier protein domain comprising the amino acid sequence of SEQ ID NO: 13 or an amino acid sequence having 90% or more identity with the amino acid sequence of SEQ ID NO: 13, and a fourth condensation domain comprising the amino acid sequence of SEQ ID NO: 14 or an amino acid sequence having 90% or more identity with the amino acid sequence of SEQ ID NO: 14 in that order from the N-terminal side.

4. A transformant, into which a tentoxin synthesis-related gene has been introduced, wherein the tentoxin synthesis-related gene encodes (a) a protein comprising the amino acid sequence of SEQ ID NO: 18; or (b) a protein having at least 90% sequence identity to the amino acid sequence set forth in SEQ ID NO: 18, and wherein the protein has activity of converting dihydrotentoxin to tentoxin.

5. The transformant of claim 3, wherein the gene has been introduced into koji mold (*Aspergillus oryzae*).

6. A method for producing tentoxin, comprising the steps of:

culturing a transformant into which a tentoxin synthesis-related gene has been introduced, wherein the tentoxin synthesis-related gene encodes (a) a protein comprising the amino acid sequence of SEQ ID NO: 18; or (b) a protein having at least 90% sequence identity to the amino acid sequence set forth in SEQ ID NO: 18, and wherein the protein has activity of converting dihydrotentoxin to tentoxin; and collecting tentoxin from the culture supernatant.

7. The transformant of claim 4, wherein the gene has been introduced into koji mold (*Aspergillus oryzae*).

8. The method of claim 1, wherein the tentoxin synthesis-related gene is from a filamentous fungus of the genus *Alternaria*.

9. The transformant of claim 3, wherein the tentoxin synthesis-related gene is from a filamentous fungus of the genus *Alternaria*.

10. The transformant of claim 4, wherein the tentoxin synthesis-related gene is from a filamentous fungus of the genus *Alternaria*.

11. The method of claim 6, wherein the tentoxin synthesis-related gene is from a filamentous fungus of the genus *Alternaria*.

12. A transformant, into which a tentoxin synthesis-related gene has been introduced, wherein the tentoxin synthesis-related gene encodes:

(a) a protein comprising the amino acid sequence of SEQ ID NO: 16; or (b) a protein having at least 90% sequence identity to the amino acid sequence set forth in SEQ ID NO: 16, and wherein the protein has activity of nonribosomal peptide synthesis of dihydrotentoxin.

13. The transformant of claim 12, wherein the tentoxin synthesis-related gene is from a filamentous fungus of the genus *Alternaria*.

14. A method for producing tentoxin, comprising the steps of:

culturing a transformant into which a tentoxin synthesis-related gene has been introduced, wherein the tentoxin synthesis-related gene encodes (a) a protein comprising the amino acid sequence of SEQ ID NO: 16; or (b) a protein having at least 90% sequence identity to the amino acid sequence set forth in SEQ ID NO: 16, and wherein the protein has activity of nonribosomal peptide synthesis of dihydrotentoxin; and collecting tentoxin from the culture supernatant.

15. The method of claim 14, wherein the tentoxin synthesis-related gene is from a filamentous fungus of the genus *Alternaria*.

* * * * *